US009878017B2

(12) United States Patent
Metzner et al.

(10) Patent No.: US 9,878,017 B2
(45) Date of Patent: Jan. 30, 2018

(54) COVALENT COMPLEX OF VON WILLEBRAND FACTOR AND FACTOR VIII, COMPOSITIONS, AND USES RELATING THERETO

(71) Applicant: CSL LIMITED, Victoria (AU)

(72) Inventors: Hubert Metzner, Marburg (DE); Stefan Schulte, Marburg (DE); Thomas Weimer, Gladenbach (DE)

(73) Assignee: CSL Ltd., Parkville (AU)

( * ) Notice: Subject to any disclaimer, the term of this patent is extended or adjusted under 35 U.S.C. 154(b) by 0 days.

(21) Appl. No.: 14/785,776

(22) PCT Filed: Apr. 22, 2014

(86) PCT No.: PCT/EP2014/058093
§ 371 (c)(1),
(2) Date: Oct. 20, 2015

(87) PCT Pub. No.: WO2014/173873
PCT Pub. Date: Oct. 30, 2014

(65) Prior Publication Data
US 2016/0200794 A1 Jul. 14, 2016

(30) Foreign Application Priority Data
Apr. 22, 2013 (EP) .................................... 13164728

(51) Int. Cl.
A61K 38/37 (2006.01)
A61K 38/36 (2006.01)
A61K 47/48 (2006.01)
C07K 14/755 (2006.01)

(52) U.S. Cl.
CPC .............. *A61K 38/37* (2013.01); *A61K 38/36* (2013.01); *A61K 47/481* (2013.01); *A61K 47/48215* (2013.01); *A61K 47/48238* (2013.01); *C07K 14/755* (2013.01); *C07K 2319/31* (2013.01); *C07K 2319/50* (2013.01)

(58) Field of Classification Search
None
See application file for complete search history.

(56) References Cited

U.S. PATENT DOCUMENTS

| 4,757,006 A | 7/1988 | Toole, Jr. et al. |
| 4,970,300 A | 11/1990 | Fulton et al. |
| 5,364,771 A | 11/1994 | Lollar et al. |
| 5,408,039 A | 4/1995 | Burnouf-Radosevich et al. |
| 5,571,784 A | 11/1996 | Reers et al. |
| 5,854,403 A | 12/1998 | Fischer et al. |
| 5,876,969 A | 3/1999 | Fleer et al. |
| 5,877,152 A | 3/1999 | Fischer et al. |
| 6,037,452 A | 3/2000 | Minamino et al. |
| 6,228,613 B1 | 5/2001 | Fischer et al. |
| 6,403,077 B1 | 6/2002 | Strom et al. |
| 7,482,013 B2 | 1/2009 | Ballance et al. |
| 7,625,866 B2 | 12/2009 | Kumpe et al. |
| 8,575,104 B2 | 11/2013 | Weimer et al. |
| 8,603,979 B2 | 12/2013 | Dickneite et al. |
| 9,095,564 B2 | 8/2015 | Dickneite et al. |
| 9,107,902 B2 | 8/2015 | Kronthaler |
| 9,290,561 B2 | 3/2016 | Weimer et al. |
| 2002/0062492 A1 | 5/2002 | Lubon et al. |
| 2003/0125250 A1 | 7/2003 | Araki et al. |
| 2003/0212042 A1 | 11/2003 | Lassila et al. |
| 2004/0087778 A1 | 5/2004 | Feige et al. |
| 2004/0132654 A1 | 7/2004 | Kumpe et al. |
| 2006/0160948 A1 | 7/2006 | Scheiflinger et al. |
| 2008/0234193 A1 | 9/2008 | Bossard et al. |
| 2010/0183556 A1 | 7/2010 | Choi et al. |
| 2012/0316116 A1 | 12/2012 | Scheiflinger et al. |
| 2014/0357564 A1 | 12/2014 | Schulte et al. |

FOREIGN PATENT DOCUMENTS

| CA | 2156991 A1 | 2/1996 |
| DE | 44 30 205 A1 | 2/1996 |
| EA | 006209 B1 | 10/2005 |
| EP | 0 503 991 B1 | 9/1992 |
| EP | 0713881 A2 | 5/1996 |
| EP | 0 784 632 B1 | 7/1997 |
| EP | 0 503 991 B1 | 9/1998 |
| EP | 0 704 632 B1 | 1/1999 |
| EP | 0772452 B1 | 8/2002 |
| EP | 0871649 B1 | 11/2002 |
| EP | 1258497 A2 | 11/2002 |
| EP | 1258497 A3 | 11/2002 |
| EP | 0710114 B1 | 2/2003 |
| EP | 1405863 A1 | 4/2004 |
| EP | 1258497 B1 | 2/2005 |
| EP | 1502921 A1 | 2/2005 |
| EP | 1867660 A1 | 12/2007 |
| JP | 2004-123744 A | 4/2004 |
| JP | 2006-101790 A | 4/2006 |
| JP | 2010-501522 A | 1/2010 |
| WO | WO 94/15625 | 7/1994 |

(Continued)

OTHER PUBLICATIONS

Aledort, L.M., "Comparative thrombotic event incidence after infusion of recombinant factor VIIa versus factor VIII inhibitor bypass activity" *J. Thromb. Haemost.*, 2:1700-1708 (2004).
Alevriadou, B.R. et al., "Real-time analysis of shear-dependent thrombus formation and its blockade by inhibitors of von Willebrand factor binding to platelets" *Blood*, 81:1263-1276 (1993).
Amano K. et al. (1995) "Autoantibody to factor VIII that has less reactivity to factor VIII/von Willebrand factor complex" Am. J. Hematol., 49:310-317.

(Continued)

*Primary Examiner* — Lianko G Garyu
(74) *Attorney, Agent, or Firm* — Finnegan, Henderson, Farabow, Garrett & Dunner, LLP

(57) ABSTRACT

The present invention relates to a covalent complex of von Willebrand Factor (VWF) and Factor VIII, wherein the complex is modified such that it has an extended half-life in vivo. The invention further relates to a method of producing the complex, as well as the therapeutic or prophylactic use of the complex for treating or preventing bleeding events.

20 Claims, 19 Drawing Sheets

(56) References Cited

FOREIGN PATENT DOCUMENTS

Figures 2A, 2B:

| WO | WO 95/26750 A1 | 10/1995 | | |
|---|---|---|---|---|
| WO | WO 97/03193 | 1/1997 | | |
| WO | WO 97/11957 | 4/1997 | | |
| WO | WO 97/24445 A1 | 7/1997 | | |
| WO | WO 97/29753 A1 | 8/1997 | | |
| WO | WO 97/34930 A1 | 9/1997 | | |
| WO | WO 97/40145 | 10/1997 | | |
| WO | WO 99/55306 | 11/1999 | | |
| WO | WO 01/79271 A1 | 10/2001 | | |
| WO | WO 02/060951 A2 | 8/2002 | | |
| WO | WO 02/103024 A2 | 12/2002 | | |
| WO | WO 03/035861 A2 | 5/2003 | | |
| WO | WO 03/076567 A2 | 9/2003 | | |
| WO | WO 03/087355 A1 | 10/2003 | | |
| WO | WO 03/093313 A2 | 11/2003 | | |
| WO | WO 2004/052401 A2 | 6/2004 | | |
| WO | WO 2004/075923 A2 | 9/2004 | | |
| WO | WO 2004/101740 A2 | 11/2004 | | |
| WO | WO 2005/000892 A2 | 1/2005 | | |
| WO | WO 2005/001025 A2 | 1/2005 | | |
| WO | WO 2005/024044 A2 | 3/2005 | | |
| WO | WO 2005/063808 A1 | 7/2005 | | |
| WO | WO 2004/067566 A1 | 8/2005 | | |
| WO | WO 2006/000448 A2 | 1/2006 | | |
| WO | WO 2006/053299 A2 | 5/2006 | | |
| WO | WO 2006/071801 A2 | 7/2006 | | |
| WO | WO 2006/108590 A1 | 10/2006 | | |
| WO | WO 2007/090584 A1 | 8/2007 | | |
| WO | WO 2007/126808 A1 | 11/2007 | | |
| WO | WO 2007/144173 A1 | 12/2007 | | |
| WO | WO 2008/005290 A2 | 1/2008 | | |
| WO | WO 2008/077616 A1 | 7/2008 | | |
| WO | WO 2009/156137 A1 | 12/2009 | | |
| WO | WO 2009156137 A1 * | 12/2009 | ........... | C07K 14/755 |
| WO | WO 2011/020866 A2 | 2/2011 | | |
| WO | WO 2011/060242 | 5/2011 | | |
| WO | WO 2011101242 A1 * | 8/2011 | ....... | A61K 47/48215 |
| WO | WO 2013/083858 A1 | 6/2013 | | |
| WO | WO 2013/106787 A1 | 7/2013 | | |
| WO | WO 2013106787 A1 * | 7/2013 | ........... | C07K 14/755 |
| WO | WO 2014/011819 A2 | 1/2014 | | |

OTHER PUBLICATIONS

Auerswald, G. et al. "The role of plasma-derived factor VIII/von Willebrand factor concentrates in the treatment of hemophilia A patients" *Hematologica*, 88(6):EREPO4 (2 pages) (2003).

Australian Patent Application No. 2009268289, by CSL Behring GmbH: Examination Report No. 1, dated Jul. 18, 2013 (5 pages).

Australian Patent Application No. 2009262476, by CSL Behring GmbH: Examination Report No. 1, dated Jan. 3, 2014.

Australian Patent Application No. 2013200843, by CSL Behring GmbH: Examination Report No. 3, dated Aug. 22, 2014 (3 pages).

Australian Patent Application No. 2013202564: Examination Report, dated Jun. 5, 2014 (4 pages).

Averkov, O.V., "Clopidogrel in treatment of ischemic heart syndrome without persistent raise of segment ST in ECG. Lessons of Investigation CURE. Which is applicable in Russia?" *J. Cardiovascular Therapy and Prevention*, N.2, pp. 67-75 (Abstract) (2004). Machine translation provided.

Baronciani, L. et al., "Molecular characterization of a multiethnic group of 21 patients with type 3 von Willebrand disease" *Thromb. Haemost.*, 84:536-540 (2000).

Beattie ,W.G. et al., "Structure and evolution of human α-fetoprotein deduced from partial sequence of cloned cDNA" *Gene*, 20:415-422 (1982).

Berntorp, E. et al., "A systematic overview of the first pasteurised VWF/FVIII medicinal product, Haemate®P/Humate ®-P: History and clinical performance" *Eur. J. Haematol.*, 80(Suppl. 70):3-35 (2008).

Bertrand, M.E. et al. "Double-Blind Study of the Safety of Clopidogrel With and Without a Loading Dose in Combination With Aspirin Compared With Ticlopidine in Combination With Aspirin After Coronary Stenting: The Clopidogrel Aspirin Stent International Cooperative Study (CLASSICS)" *Circulation*, 102:624-629 (2000).

Bettini R. et al. (2001) Review of *Handbook of Pharmaceutical Excipients*, 3rd Ed., by A. Kibbe (Ed.).; *J. Control. Release*, 71:352-353 (2001).

Bi, L. et al. (1995) "Targeted disruption of the mouse factor VIII gene produces a model of haemophilia A" *Nat. Genet.*, 10:119-121.

Bi, L. et al. (1996) "Further characterization of factor VIII-deficient mice created by gene targeting: RNA and protein studies" *Blood*, 88(9):3446-3450.

Björkman, S. et al., "Pharmacokinetics of Coagulation Factors. Clinical Relevance for Patients with Haemophilia" *Clin. Pharmacokinet.*, 40(11):815-832 (2001).

Born, G. et al., "Antiplatelet Drugs" *British Journal of Pharmacology*, 147:S241-S251 (2006).

Canadian Patent Application No. 2,690,218: Office Action, dated May 8, 2014 (2 pages).

Chuang, V.T.G. et al., "Pharmaceutical strategies utilizing recombinant human serum albumin" *Pharmaceutical Research*, 19:569-577 (2002).

Colman, R. et al. (Eds.) *Hemostasis and Thrombosis: Basic Principles and Clinical Practice*, 5" Edition. Philadelphia, Pennsylvania: Lippincott Williams & Wilkins, 2006; pp. 710-713.

Cooke, N.E. et al., "Serum vitamin D-binding protein is a third member of the albumin and alpha fetoprotein gene family" *J. Clin. Invest.*, 76:2420-2424 (1985).

CSL Behring GmbH, "Summary of Product Characteristics," Haemate P 500 Powder and solvent for solution for injection or infusion, revised Mar. 21, 2013, 15 pages.

CSL Behring GmbH, "Haemate ® P—Producktmonografie" Jan. 2007, with English translation (62 total pages).

Dalton, R.G. and G.F. Savidge (1989) "Progress in vWf methodology and its relevance in vWD" in *Factor VIII—von Willebrand Factor*. Seghatchian M.J. & Savidge G.F. (eds.), CRC Press, Inc., Boca Raton, FL; vol. 1, pp. 129-145.

Dang, L.T. et al., "Phylogenetic and Functional Analysis of Histidine Residues Essential for pH-dependent Multimerization of von Willebrand Factor" *J. Biol. Chem.*, 286(29):25763-25769 (2011).

Denis, C. et al. (1998) "A mouse model of severe von Willebrand disease: Defects in hemostasis and thrombosis" *Proc. Natl. Acad. Sci. USA*, 95:9524-9529.

Dickneite, G. et al. "Characterization of the coagulation Deficit in Porcine Dilutional Coagulopathy and Substitution with a Prothrombin Complex Concentrate" *Anesth. Analg.*, 106:1070-1077 (2008).

Dickneite, G. et al. "Reduction of r-hirudin induced bleeding in pigs by the administration of von Willebrand factor" *Platelets*, 7:283-290 (1996).

Dickneite, G. et al. "Development of an Anti-Bleeding Agent for Recombinant Hirudin Induced Skin Bleeding in the Pig" *Thromb. Haemost.*, 80:192-198 (1998).

Dimichele, D.M. et al., "Use of DDAVP in Inherited and Acquired Platelet Dysfunction" *Am. J. Hematol.*, 33:39-45 (1990).

Dumont, J.A. et al., "Monomeric Fc Fusions" *Biodrugs*, 20(3):151-160 (2006).

Duttaroy, A. et al., "Development of a long-acting insulin analog using albumin fusion technology" *Diabetes*, 54:251-258 (2005).

Elg, M. et al, "Effects of Agents, Used to Treat Bleeding Disorders, on Bleeding Time Prolonged by a Very High Dose of a Direct Thrombin Inhibitor in Anesthesized Rats and Rabbits" *Thrombosis Research*, 101:159-170 (2001).

Enayat, M.S. et al., "Aberrant dimerization of von Willebrand factor as the result of mutations in the carboxy-terminal region: identification of 3 mutations in members of 3 different families with type 2A (phenotype IID) von Willebrand disease" *Blood*, 98:674-680 (2001).

Ettingshausen, C.E. and W. Kreuz (2006) "Recombinant vs. plasma-derived products, especially those with intact VWF, regarding inhibitor development" *Haemophilia*, 12(Suppl. 6):102-106.

(56) References Cited

OTHER PUBLICATIONS

European Patent Application No. 08011429, by CSL Behring GmbH: Extended Search Report, including Search Opinion, dated Dec. 29, 2008 (11 pages).
European Patent Application No. 09768986.: Reply to Communication pursuant to Rules 161(1) and 162, filed Feb. 17, 2011 (16 pages).
European Application No. 09777111.7 (Patent No. 2310043): Communication of a notice of opposition, dated Jun. 28, 2013, 1 page.
European Application No. 09777111.7 (Patent No. 2310043): Notice of Opposition, dated Jun. 18, 2013, 38 pages.
European Patent Application No. 12155509.8, by CSL Behring GmbH: Extended European Search Report, including Search Opinion, dated May 22, 2012 (4 pages).
European Patent Application No. 12167609, by CSL Behring GmbH: Extended European Search Report, including Search Opinion, dated Jul. 13, 2012 (7 pages).
Fay, P.J. et al., "Characterization of the interaction between the A2 subunit and A1/A3-C1-C2 dimer in human factor VIIIa," *J. Biol. Chem.*, 267:13246-13250 (1992).
Fay, P.J. et al., "Human factor VIIIa subunit structure" *J. Biol. Chem.*, 266:8957-8962 (1991).
Fischer, B.E. et al. "Effect of multimerization of human and recombinant von Willebrand factor on platelet aggregation, binding to collagen and binding of coagulation factor VIII" *Thromb. Res.*, 84(1):55-66 (1996).
Fischer, B.E. et al., "Structural analysis of recombinant von Willebrand factor produced at industrial scale fermentation of transformed CHO cells co-expressing recombinant furin" *FEBS Letters*, 375:259-262 (1995).
Gale et al., "Structural Basis for Hemophilia A Caused by Mutations in the C Domains of Blood Coagulation Factor VIII" *Thomb. Haemost,*. 83(1):78-85 (2000).
Gao, Z. et al., "Development, characterization, and evaluation of a fusion protein of a novel gulcagon-like peptide-1 (GLP-1) analog and human serum albumin in *Pichia pastoris*" *Biosci. Biotechnol. Biochem.*, 73(3):688-694 (2009).
Gensana, M. et al., "Influence of von Willebrand Factor on the Reactivity of Human Factor VIII Inhibitors with Factor VIII" *Haemophilia*, 7:369-374 (2001).
German National Library for Medicine, Letter dated Mar. 28, 2013, to Bird & Bird LLP, regarding the registration date of the journal Vascular Care, vol. 14, issue 1, 2008; with English translation (3 pages).
German Patent Application No. 10 2008 032 361.6 By CSL Behring GmbH: Examination Report, dated Sep. 6, 2011, with English translation (11 pages).
Goudemand, J. et al., "Pharmacokinetic studies on Wilfactin®, a von Willebrand factor concentrate with a low factor VIII content treated with three virus-inactivation/removal methods" *J. Thromb. Haemost.*, 3:2219-2227 (2005).
Goudemand, J. (2007) "Inhibitor development in haemophilia A: the role of von Willebrand factor/factor VIII concentrates" *Haemophilia*, 13(Suppl. 5):47-51.
Gralnick, H.R. et al., "A monomeric von Willebrand factor fragment, Leu-504-Ser-728, inhibits von Willebrand factor interaction with glycoprotein Ib-IX" *Proc. Natl. Acad. Sci. USA*, 89:7880-7884 (1992).
Hilbert, L. et al., "Expression of two type 2N von Willebrand disease mutations identified in exon 18 of von Willebrand factor gene" *Br. J. Haematol.*, 127:184-189 (2004).
Hommais, A. et al., "Impaired dimerization of von Willebrand factor subunit due to mutation A2801D in the CK domain results in a recessive type 2A subtype IID von Willebrand disease" *Thromb. Haemost.*, 95: 776-781 (2006).
Huang, YS. et al., "Preparation and characterization of a potent, long-lasting recombinant human serum albumin-interferon-α2b fusion protein expressed in *Pichia pastoris*" *Eur. J. Pharm. Biopharm.*, 67:301-308 (2007).

International Preliminary Report on Patentability issued in International Application No. PCT/EP2013/052948, dated Aug. 28, 2014 (6 pages).
International Search Report and Written Opinion issued in International Application No. PCT/EP2008/004770, dated Sep. 5, 2008 (12 pages).
International Search Report and Written Opinion issued in International Application No. PCT/EP2009/004549, dated Aug. 7, 2009 (12 pages).
International Search Report and Written Opinion issued in International Application No. PCT/EP2009/005027, dated Nov. 3, 2009 (13 pages).
International Search Report and Written Opinion issued in International Application No. PCT/EP2013/052948, dated Mar. 22, 2013 (12 pages).
International Preliminary Report on Patentability issued in International Application No. PCT/EP2014/058093, dated Oct. 27, 2015 (9 pages).
Japanese Patent Application No. 2010-511541, by CSL Behring GmbH: English translation of Notification of Reasons for Refusal, Dispatch date: Dec. 25, 2012 (6 pages).
Japanese Patent Application No. 2010-511541, by CSL Behring GmbH: Decision of Refusal, Drafting date: Feb. 25, 2014, Dispatch date: Mar. 4, 2014; with English translation (5 pages).
Japanese Patent Application No. 2011-515200 by CSL Behring GmbH: Notice of Rejection, dated Feb. 4, 2014, with English translation (11 pages).
Japanese Patent Application No. 2011-517038: Notice of Reason(s) for Rejection, dated Apr. 1, 2014, with English translation. (7 pages).
Kang, W-K et al., "A biologically active angiogenesis inhibitor, human serum albumin-TIMP-2 fusion protein, secreted from *Saccharomyces cerevisiae*" *Protein Expression and Purification*, 53:331-338 (2007).
Kang, W. et al. "The Effect of Preoperative Clopidogrel on Bleeding After Coronary Artery Bypass Surgery" *J. Surg.*, 64(2):88-92 (2007).
Kaufman, R.J. et al. (1989) "Effect of von Willebrand factor coexpression on the synthesis and secretion of factor VIII in Chinese hamster ovary cells" *Mol. Cell. Biol.*, 9(3):1233-1242.
Kaveri, S.V. et al., "Factor VIII Inhibitors: Role of von Willebrand Factor on the Uptake of Factor VIII by Dendritic Cells" *Hemophilia*, 13(Suppl. 5):61-64 (2007).
Korean Patent Application No. 10-2011-7001530: Notice of Preliminary Rejection, dated Oct. 24, 2014, with English translation (14 pages).
Korean Patent Appln. No. 10-2009-7025872, by CSL Behring GmbH: English translation of Notice of Preliminary Rejection, dated Nov. 25, 2014 (5 pages).
Koscielny, J. et al., "A Practical Concept for Preoperative Management of Patients With Impaired Primary Hemostasis" *Clin. Appl. Thrombosis/Hemostasis*, 10(2):155-166 (2004).
Koscielny et al., "Perioperative Management of patients on ASA/clopidrogel medication" *Vascular Care*, 14:28-40 (2008), with English translation.
Landskroner, K.A. et al. (2005) "Thromboelastography measurements of whole blood factor VIII-deficient mice supplemented with rFVLLL" *Haemophilia*, 11:346-352.
Lee, G. (2000) Review of *Pharmaceutical Formulation Development of Peptides and Proteins*, by S. Frokjaer and L. Hovgaard. *Eur. J. Pharm. Biopharm.*, 50:329.
Lenting et al., "The Life Cycle of Coagulation Factor VIII in View of Its Structure and Function" *Blood*, 92(11):3983-3996 (1998).
Lethagen, S. et al., "von Willebrand factor/factor VIII concentrate (Haemate ® P) dosing based on pharmacokinetics: a prospective multicenter trial in elective surgery" *J. Thromb. Haemost.*, 5:1420-1430 (2007).
Lethagen, S. et al. "New Bleeding Time Devices with Retractable Blades Evaluated in Children, Healthy Volunteers and Patients with Prolonged Bleeding Time" *Thromb. Haemost.*,70(4):595-597 (1993).

(56) References Cited

OTHER PUBLICATIONS

LFB Biomedicaments, "Gebrauchsinformation: Information für den Anwender. Wilfactin 1000 I.U./10 ml. Pulver and Lösungsmittel zur Herstellung einer Injektionslösung. Humanes Factor von Willebrand. [Package Leaflet: Information for the User—Wilfactin 1000 I.U./10ml. Powder and solvent for preparation of a solution for injection. Human von Willebrand factor]," [online]: http://bijsluiters.fagg-afmps.be, 10 pages (2011). English translation of p. 1.
Lichenstein, H.S. et al., "Afamin is a new member of the albumin, α-fetoprotein, and vitamin D-binding protein gene family" *J. Biol. Chem.*, 269(27):18149-18154 (1994).
Liu, M-L. et al., "Hemophilic factor VIII C1- and C2-domain missense mutations and their modeling to the 1.5-angstrom human C2-domain crystal structure" *Blood*, 96(3):979-987 (2000).
Mannucci, P.M. et al., "Controlled Trial of Desmopressin in Liver Cirrhosis and Other Conditions Associated With a Prolonged Bleeding Time" *Blood*, 67(4):1148-1153 (1986).
Matsumoto, M. et al., "TTP and anti-platelet agents" *Hematology & Oncology*, 41(3):238-244 (2000), with English translation.
Melder, R.J. et al., "Pharmacokinetics and in vitro and in vivo anti-tumor response of an interleukin-2-human serum albumin fusion protein in mice" *Cancer Immunol. Immunother.*, 54:535-547 (2005).
Metzner, H.J. et al., "Genetic fusion to albumin improves the pharmacokinetic properties of factor IX" *Thromb. Haemost.*, 102:634-644 (2009).
Nogami, K. et al., "A Novel Mechanism of Factor VIII Protection by von Willebrand Factor from Activated Protein C-Catalyzed Inactivation" *Blood*, 99(11):3993-3998 (2002).
Pfistershammer, K. et al., "Recombinant factor VIII and factor VIII-von Willebrand factor complex do not present danger signals for human dendritic cells" *Thromb. Haemost.*, 96:309-316 (2006).
Plaimauer, B. et al., "Recombinant von Willebrand Factor: Preclinical Development" *Seminars in Thrombosis and Hemostasis*, 27(4):395-403 (2001).
Pock, K. et al., "Biochemical comparison of VWF/FVIII concentrates. Are there differences in product characteristics and purity?" Hemophilia World Congress 2008. Octapharma. [online]. Retrieved from: http://www.vonwillebrand.se/PageFiles/484/Biokemiska%20j%C3%A4mf%C3%B6relser%20mellan%20olika%20VWF-FVIII-koncentrat.pdf (2 pages).
Ruggeri, Z.M. "Structure and function of von Willebrand factor" *Thromb. Haemost.*, 82(2):576-584 (1999).
Ruggeri, Z.M. "von Willebrand factor and fibrinogen" *Current Opinion in Cell Biology*, 5:898-906 (1993).
Ruggeri, Z.M. "New Insights Into the Mechanisms of Platelet Adhesion and Aggregation" *Seminars in Hematology*, 31(3):229-239 (1994).
Russian Patent Application No. 2011104705/15(006622): English translation of Official Action, dated Sep. 22, 2014 (3 pages).
Russian Patent Application No. 2011102366: English translation of Decision to Grant, May 2014 (5 pages).
Russian Patent Application No. 2011102366, filed Jun. 24, 2009, by CSL Behring GmbH: Office Action, dated Aug. 26, 2013, with English translation (6 pages).
Saenko, E.L. et al., "Molecular defects in coagulation factor VIII and their impact on Factor VIII function" *Vox Sanguinis*, 83:89-96 (2002).
Saenko, E.L. et al., "Strategies towards a longer acting factor VIII" *Haemophilia*, 12:42-51 (2006).
Schneppenheim, R. et al., "Defective dimerization of von Willebrand factor subunits due to a Cys→Arg mutation in type IID von Willebrand disease" *Proc. Natl. Acad. Sci. USA*, 93:3581-3586 (1996).
Schneppenheim, R. et al., "Expression and characterization of von Willebrand factor dimerization defects in different types of von Willebrand disease" *Blood*, 97:2059-2066 (2001).
Seffernick, J.L. et al., "Melamine Deaminase and Atrazine Chlorohydrolase: 98 Percent Identical but Functionally Different" *J. Bacteriol.*, 183(8):2405-2410 (2001).
Sheffield, W.P. et al., "Effects of genetic fusion of factor IX to albumin on in vivo clearance in mice and rabbits" *Br. J. Haematol.*, 126:565-573 (2004).
Shumakov, V.A. et al., "Antithrombocytic therapy in patients suffering from CHD: clopidogrel and/or acetylsalicylic acid" *NMT-Journal*, N.4, pp. 26-30 (2007), with machine English translation provided.
Soukharev, S. et al., "Expression of factor VIII in recombinant and transgenic systems" *Blood Cells, Molecules and Diseases*, 28:234-248 (2002).
Spiegel Jr., P.C. et al., "Structure of a factor VIII C2 domain-immunoglobulin G4κ Fab complex: identification of an inhibitory antibody epitope on the surface of factor VIII" *Blood*, 98(1):13-19 (2001).
Tjernberg, P. et al., "Homozygous C2362F von Willebrand factor induces intracellular retention of mutant von Willebrand factor resulting in autosomal recessive severe von Willebrand disease" *Br. J. Haematol.*, 133:409-418 (2006).
Tomokiyo, K. et al., "Von Willebrand Factor Accelerates Platelet Adhesion and Thrombus Formation on a Collagen Surface in Platelet-reduced Blood Under Flow Conditions" *Blood*, 105(3):1078-1084 (2005).
U.S. Appl. No. 10/670,563, filed Sep. 26, 2003, by Kumpe et al.: Amendment after Final, Remarks, and Attachments (Declaration of Gerhardt Kumpe), dated Mar. 14, 2008.
U.S. Appl. No. 10/670,563, filed Sep. 26, 2003, by Kumpe et al.: Supplemental Amendment After Final and Remarks, dated Jul. 3, 2006.
U.S. Appl. No. 13/212,879, filed Aug. 18, 2011, by Ballance: Office Action, dated Nov. 8, 2012.
Uniprot Protein Database, Acc. No. L8E853, von Willebrand Factor, human, accessed on Oct. 28, 2015 (8 pages).
Uniprot Protein Database, Acc. No. P04275, von Willebrand Factor, human; accessed on Oct. 29, 2015 (22 pages).
UniProt Protein Database, Acc. No. Q28834, Von Willebrand Factor, accessed Jun. 14, 2015 (5 pages).
Vehar, G.A. et al., "Structure of human factor VIII" *Nature*, 312:337-342 (1984).
Vlot, A.J. et al., "The Affinity and Stoichiometry of Binding of Human Factor VIII to von Willebrand Factor" *Blood*, 85(11):3150-3157 (1995).
Voorberg, J. et al. "Domains Involved in Multimer Assembly of von Willebrand factor (vWF): Multimerization Is Independent of Dimerization" *EMBO J.*, 9(3):797-803 (1990).
Weimer, T. et al., "Prolonged in-vivo half-life of factor VIIa by fusion to albumin" *Thromb Haemost*, 99:659-667 (2008).
Wells, J.A., "Additivity of Mutational Effects in Proteins" *Biochemistry*, 29(37):8509-8517 (1990).
Wood, W.I. et al., "Expression of active human factor VIII from recombinant DNA clones" *Nature*, 312:330-337 (1984).
Rizza et al., 1982. "Coagulation Assay of VIIIC and IXC," The Hemophilias: 18-38.
Devereux et al., 1984. "A comprehensive set of sequence analysis programs for the VAX," Nucleic Acids Research: vol. 12:1, 387-395.
Rosen, 1984. "Assay of Factor VIII:C with a Chromogenic Substrate," Scand J Haematol: vol. 33, 139-145.
Lipman et al., 1985. "Rapid and Sensitive Protein Similarity Searches," Science: vol. 227, 1435-1441.
Collins et al., 1987. "Molecular cloning of the human gene for von Willebrand factor and identification of the transcription initiation site," PNAS: vol. 84, 4393-4397.
Tatewaki et al., 1988. "Multimeric Composition of Plasma von Willebrand Factor in Chronic Myelocytic Leukemia," Thrombosis Research: vol. 52, 23-32.
Kaufman et al., 1989. "Effect of von Willebrand Factor Coexpression on the Synthesis and Secretion of Factor VIII in Chinese Hamster Ovary Cells," Molecular and Cell Biology: vol. 9:3, 1233-1242.
Leyte et al., 1989. "The interaction between human blood-coagulation Factor VIII and von Willebrand Factor," Biochem J.: vol. 257, 679-683.

(56) References Cited

OTHER PUBLICATIONS

Altschul et al., 1990. "Basic Local Alignment Search Tool," J. Mol. Biol.: vol. 215, 403-410.
Kaufman, 1992. "Expression and Structure-Function Properties of Recombinant Factor VIII," Transfusion Medicine Reviews: vol. VI, 4, 235-246.
Fischer et al., 1994. "Structural analysis of recombinant von Willebrand factor: identification of hetero-and homo-dimers," FEBS: vol. 351, 345-348.
Thompson et al., 1994. "Clustal W: improving the sensitivity of progressive multiple sequence alignment through sequence weighting, position-specific gap penalties and weight matrix choice," Nucleic Acid Research: vol. 22:22, 4673-4680.
Metzner et al., 1998. "Characterization of factor VIII/von Willebrand factor concentrates using a modified method of von Willebrand factor multimer analysis," Haemophilia: vol. 4:3, 25-32.
Kallas et al., 2001. "The von Willebrand factor collagen-binding activity assay: clinical application," Ann Hematol: vol. 80, 466-471.
Federici et al., 2004. "A sensitive ristocetin co-factor activity assay with recombinant glycoprotein Ibα for the diagnosis of patients with low von Willebrand factor levels," Haematologica: vol. 89, 77-85.
Sucker et al., 2006. "Determination of von Willebrand Factor Activity: Evaluation of the HaemosIL™ Assay in Comparison With Established Procedures," Clinical and Applied Thrombosis/Hemostasis: vol. 12:3, 305-310.
McCue et al., 2009. "Application of a novel affinity absorbent for the capture and purification of recombinant Factor VIII compounds," Journal of Chromatography A: vol. 1216:45, 7824-7830.
Schellenberger et al., 2009. "A recombinant polypeptide extends the in vivo half-life of peptides and proteins in a tunable manner," Nature Biotechnology: vol. 27:12, 1186-1190.
Schneppenheim et al., 2011. "von Willebrand factor: the complex molecular genetics of a multidomain and multifunctional protein," Journal of Thrombosis and Haemostasis: vol. 9:1, 209-215.
Veyradier et al., 2011. "Validation of the first commercial ELISA for type 2N von Willebrand's disease diagnosis," Haemophilia: vol. 17, 944-951.
Zhou et al., 2012. "Sequence and structure relationships within von Willebrand factor," Blood: vol. 120:2, 449-458.
European Search Report 13164728.1-1456, dated Sep. 4, 2013 (9 pages).
WO Search Report PCT/EP2014/058093, dated Jul. 17, 2014 (13 pages).
Amano et al., 1998. "Mutation at either Arg336 or Arg562 in Factor VIII Is Insufficient for Complete Resistance to Activated Protein C (APC)-mediated Inactivation: Implications for the APC Resistance Test," Thromb Haemost: vol. 79; 557-563.
Lollar, 1999. "Characterization of Factor VIII B-Cell Inhibitory Epitopes," Thrombosis and Haemostasis: vol. 82(2), 505-508.
Ananyeva et al., 2001. "Catabolism of the Coagulation Factor VIII Can We Prolong Lifetime of fVIII in Circulation?," TCM: vol. 11:6, 251-257.
Miao et al., 2004. "Bioengineering of coagulation factor VIII for improved secretion," Blood: vol. 103, 3412-3419.
Pipe 2004. "Coagulation Factors with Improved Properties for Hemophilia Gene Therapy," Seminars in Thrombosis and Hemostasis: vol. 30:2, 227-237.
Swaroop et al., 1997. "Mutagenesis of a Potential Immunoglobulin-binding Protein-binding Site Enhances Secretion of Coagulation Factor VIII," The Journal of Biological Chemistry: vol. 272:39, 24121-24124.
Oh et al., 1999. "Synthesis of recombinant blood coagulation factor VIII (FVIII) heavy and light chains and reconstitution of active form of FVIII," Experimental and Molecular Medicine: vol. 31:2, 95-100.
Gale et al., 2006. "Intrinsic stability and functional properties of disulfide bond-stabilized coagulation factor VIIIa variants," Journal of Thrombosis and Haemostasis: vol. 4, 1315-1322.
Wakabayashi et al. 2005. "A Glu113Ala Mutation within a Factor VIII $Ca^{2+}$-Binding Site Enhances Cofactor Interations in Factor Xase," Biochemistry: vol. 44, 10298-10304.
Japanese Patent Publication No. JP 2006-101790 A, by Japan Health Sciences Foundation: Sequence listing, pp. 1-190, accessed on Japanese Platform for Patent Information website, https://www4.j-platpat.inpit.go.jp, on May 2, 2016.

\* cited by examiner

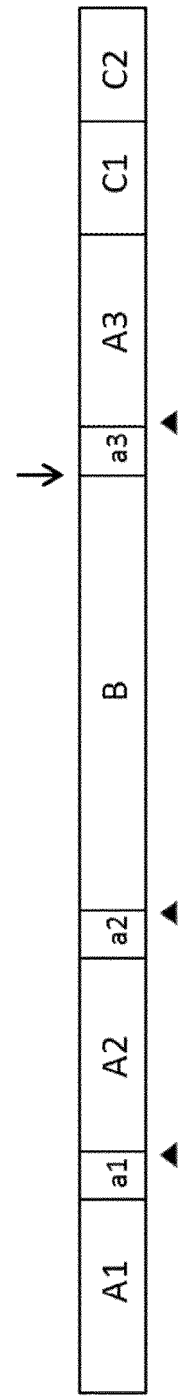
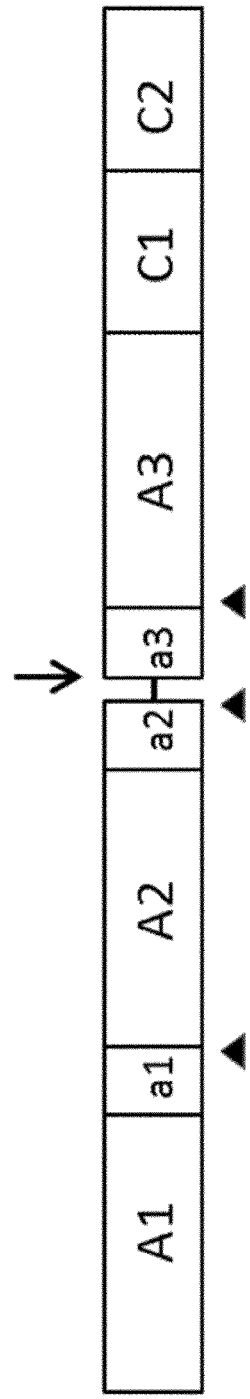
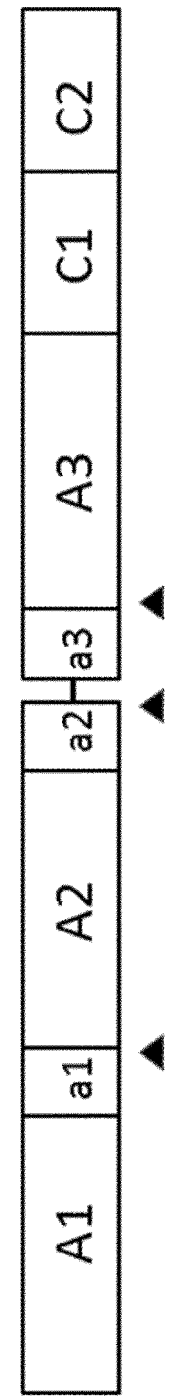

| D1 | D2 | D' | D3 | A1 | A2 | A3 | D4 | C1 | C2 | C3 | C4 | C5 | C6 | CK |

| D' | D3 | A1 | A2 | A3 | D4 | C1 | C2 | C3 | C4 | C5 | C6 | CK |

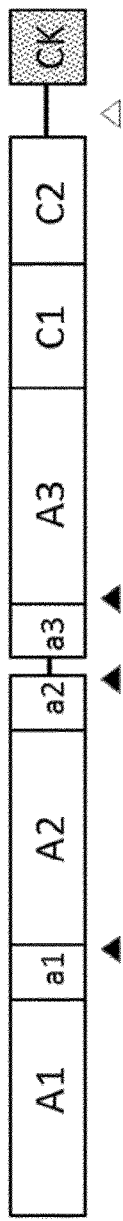
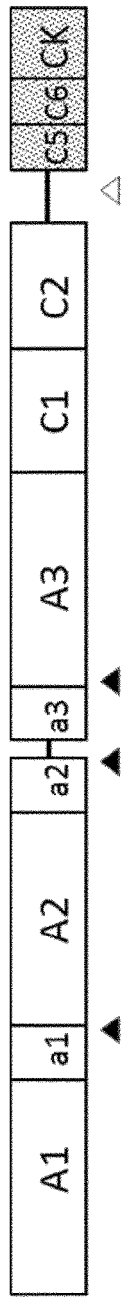
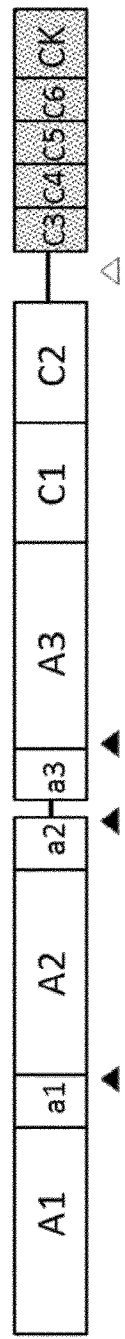
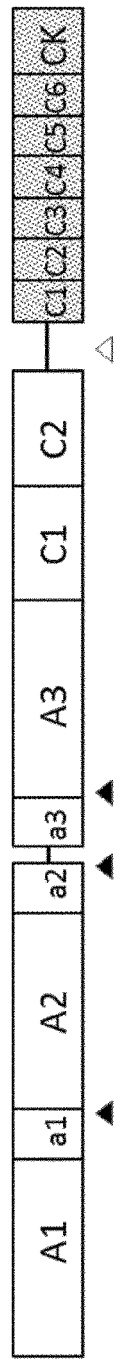
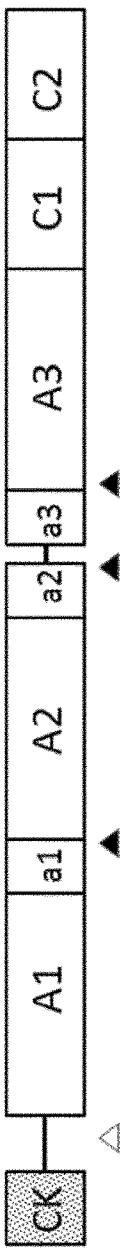

FIG. 10A     FIG. 10B
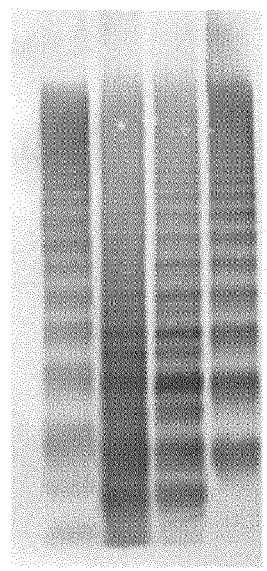 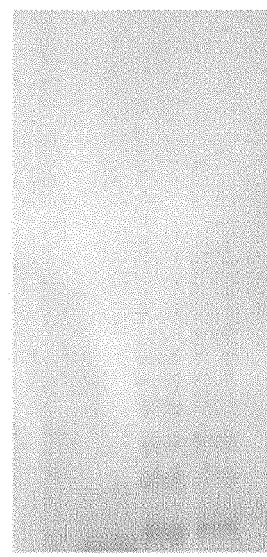

FVIII

VWF

COVALENT COMPLEX OF VON WILLEBRAND FACTOR AND FACTOR VIII, COMPOSITIONS, AND USES RELATING THERETO

This application is the U.S. national stage entry under 35 U.S.C. §371 of International Application No. PCT/EP2014/058093, filed on Apr. 22, 2014 and published as WO 2014/173873 A1, which claims priority to European Patent Application No. 13164728.1, filed on Apr. 22, 2013. The contents of these applications are each incorporated herein by reference in their entirety.

The present invention relates to a covalent complex of von Willebrand Factor or variants thereof (VWF) and Factor VIII or variants thereof (Factor VIII), wherein the complex is modified such that it has an extended half-life in vivo. The invention further relates to a method of producing the complex, as well as the therapeutic or prophylactic use of the complex for treating or preventing bleeding events.

There are various bleeding disorders caused by deficiencies of blood coagulation factors. The most common disorders are hemophilia A and B, resulting from deficiencies of blood coagulation factor VIII and IX, respectively. Another known bleeding disorder is von Willebrand disease.

In plasma factor VIII (FVIII) exists mostly as a noncovalent complex with von Willebrand Factor. Mature FVIII, a polypeptide of up to 2332 amino acids after pro-peptide cleavage, is composed of several domains as depicted in FIGS. 1A-1C. FVIII's function in coagulation is to accelerate factor IXa-dependent conversion of factor X to Xa. Due to the complex formation of FVIII and von Willebrand Factor it was assumed for a long time that FVIII and von Willebrand Factor functions are two functions of the same molecule. Only in the seventies it became clear that FVIII and von Willebrand Factor are separate molecules that form a complex under physiologic conditions. In the eighties, a dissociation constant of FVIII and von Willebrand Factor of about 0.2 nmol/L was determined (Leyte et al., Biochem J 1989, 257: 679-683) and the DNA sequence of both molecules was determined.

Classic hemophilia or hemophilia A is an inherited bleeding disorder. It results from a chromosome X-linked deficiency of blood coagulation FVIII, and affects almost exclusively males with an incidence of between one and two individuals per 10,000. The X-chromosome defect is transmitted by female carriers who are not themselves hemophiliacs. The clinical manifestation of hemophilia A is an increased bleeding tendency. Prior to the introduction of treatment with FVIII concentrates, the mean life span for a person with severe hemophilia was less than 20 years. The use of concentrates of FVIII from plasma has considerably improved the situation for the hemophilia A patients, increasing the mean life span extensively, giving most of them the possibility to live a more or less normal life. However, there have been certain problems with the plasma derived concentrates and their use, the most serious of which have been the transmission of viruses such as viruses causing hepatitis B, non-A non-B hepatitis and HIV. However, different virus inactivation methods and new highly purified FVIII concentrates have recently been developed which established a very high safety standard for plasma-derived FVIII.

In severe hemophilia A patients undergoing prophylactic treatment FVIII has to be administered intravenously (i.v.) about 3 times per week due to the short plasma half-life of FVIII of about 12 hours. Each i.v. administration is cumbersome, associated with pain, and entails the risk of an infection, especially as this is mostly done at home by the patients themselves or by the parents of children being diagnosed with hemophilia A.

It would thus be highly desirable to create a FVIII with increased functional half-life allowing the manufacturing of pharmaceutical compositions containing FVIII, which have to be administered less frequently.

Several attempts have been made to prolong the functional half-life of FVIII either by reducing its interaction with cellular receptors (WO 03/093313A2, WO 02/060951A2), by covalently attaching polymers to FVIII (WO 94/15625, WO 97/11957 and U.S. Pat. No. 4,970,300), by encapsulation of FVIII (WO 99/55306), by the introduction of novel metal binding sites (WO 97/03193), by covalently attaching the A2 domain to the A3 domain either by peptidic (WO 97/40145 and WO 03/087355) or disulfide linkage (WO 02/103024A2) or by introducing mutations that prevent thrombin cleavage between the A1 and A2 domains and therefore keep the A1 domain covalently attached to the A2 domain after thrombin activation (WO2006/108590).

Another approach to enhance the functional half-life of FVIII or von Willebrand Factor is by PEGylation of FVIII (WO 2007/126808, WO 2006/053299, WO 2004/075923) or by PEGylation of von Willebrand Factor (WO 2006/071801), with the idea that pegylated von Willebrand Factor, by having an increased half-life, would indirectly also enhance the half-life of FVIII present in plasma. In addition fusion proteins of FVIII with half-life enhancing polypeptides like albumin or the constant region Fc of immunoglobulins have been described (WO 2004/101740, WO2008/077616 and WO 2009/156137).

Von Willebrand Factor, which is missing, functionally defect or only available in reduced quantity in different forms of von Willebrand disease (VWD), is a multimeric adhesive glycoprotein present in the plasma of mammals, which has multiple physiological functions. During primary hemostasis von Willebrand Factor acts as a mediator between specific receptors on the platelet surface and components of the extracellular matrix such as collagen. Moreover, von Willebrand Factor serves as a carrier and stabilizing protein for procoagulant FVIII. Von Willebrand Factor is synthesized in endothelial cells and megakaryocytes as a 2813 amino acid precursor molecule. The amino acid sequence and the cDNA sequence of wild-type VWF are disclosed in Collins et al. 1987, Proc Natl. Acad. Sci. USA 84:4393-4397. The precursor polypeptide, pre-pro-von Willebrand Factor, consists of a 22-residue signal peptide, a 741-residue pro-peptide and the 2050-residue polypeptide found in mature plasma von Willebrand Factor (Fischer et al., FEBS Lett. 351: 345-348, 1994), see also FIG. 2A for pro-von Willebrand Factor and FIG. 2B for mature von Willebrand Factor monomer unit. After cleavage of the signal peptide in the endoplasmatic reticulum a C-terminal disulfide bridge is formed between two monomers of von Willebrand Factor. During further transport through the secretory pathway 12 N-linked and 10 O-linked carbohydrate side chains are added. More importantly, von Willebrand Factor dimers are multimerized via N-terminal disulfide bridges and the propeptide of 741 amino acids length is cleaved off by the enzyme PACE/furin in the late Golgi apparatus. The propeptide as well as the high-molecular-weight multimers of von Willebrand Factor (VWF-HMWM) are stored in the Weibel-Pallade bodies of endothelial cells or in the α-Granules of platelets.

Once secreted into plasma the protease ADAMTS13 cleaves ultra-large von Willebrand Factor multimers within the A2 domain of von Willebrand Factor. Plasma von Willebrand Factor consists of a whole range of multimers ranging from single dimers of approx. 500 kDa to multimers consisting of up to or even more than 20 dimers of a molecular weight of over 10,000 kDa. The VWF-HMWM have the strongest hemostatic activity, which can be measured by a ristocetin cofactor activity assay (VWF:RCo). The higher the ratio of VWF:RCo/von Willebrand Factor antigen, the higher the relative amount of high molecular weight multimers.

Defects in von Willebrand Factor are the cause of von Willebrand disease (VWD), which is characterized by a more or less pronounced bleeding phenotype. VWD type 3 is the most severe form in which von Willebrand Factor is essentially completely missing, VWD type 1 relates to a reduced level of von Willebrand Factor and its phenotype can be very mild. VWD type 2 relates to qualitative defects of von Willebrand Factor and can be as severe as VWD type 3. VWD type 2 has many sub-forms, some of them being associated with the loss or the decrease of high molecular weight multimers. VWD type 2A is characterized by a loss of both intermediate and large multimers, and is therefore characterised by qualitatively defective VWF with a decreased ability to bind platelet glycoprotein 1 receptor. VWD type 2B is characterized by a loss of highest-molecular-weight multimers. The ability of the qualitatively defective VWF to bind to glycoprotein 1 receptor on the platelet membrane is abnormally enhanced, leading to its spontaneous binding to platelets and subsequent clearance of the bound platelets and of the large von Willebrand Factor multimers. VWD type 2M is also a qualitative defect in von Willebrand Factor characterized by its decreased ability to bind to glycoprotein 1 receptor on the platelet membrane, but a normal multimer distribution, as are von Willebrand Factor antigen levels. VWD type 2N (Normandy) is a qualitative defect in von Willebrand Factor, where there is a deficiency of von Willebrand Factor binding to coagulation factor FVIII. Although the quantity of von Willebrand Factor and von Willebrand Factor multimers is normal, patients show a decreased level in FVIII, leading to a similar phenotype as haemophilia A.

VWD is the most frequent inherited bleeding disorder in humans and can be—depending on the type of VWD—treated by therapy with 1-Desamino-8-D-Arginin-Vasopressin (DDAVP) to release von Willebrand Factor from intracellular storage pools or by replacement therapy with concentrates containing von Willebrand Factor of plasmatic or recombinant origin. Von Willebrand Factor can be prepared from human plasma as for example described in EP 0503991. EP 0784632 describes a method for isolating recombinant von Willebrand Factor.

In plasma FVIII binds with high affinity to von Willebrand Factor, which protects it from premature catabolism and thus plays, in addition to its role in primary hemostasis, a crucial role in the regulation of plasma levels of FVIII. As a consequence von Willebrand Factor is also a central factor in the control of secondary hemostasis. The half-life of non-activated FVIII bound to von Willebrand Factor in plasma is about 12 hours. In VWD type 3, where no or almost no von Willebrand Factor is present, the half-life of FVIII is only about 2 hours, leading to symptoms of mild to moderate hemophilia A in such patients due to decreased concentrations of FVIII.

The stabilizing effect of von Willebrand Factor on FVIII has also been used to aid recombinant expression of FVIII in CHO cells (Kaufman et al. 1989, Mol Cell Biol). Other recent attempts to use von Willebrand Factor for stabilizing FVIII have been disclosed in several recent patent applications (WO2011060242, WO2013083858, WO2013106787, WO2014011819).

There is still a need for further, better approaches to increase the half-life of FVIII. It has been found by the inventors of this application that a covalent attachment of a FVIII molecule to a half-life extended von Willebrand Factor molecule will provide a half-life extension to the FVIII moiety such that its half-life will be similar to that of the unfused half-life extended von Willebrand Factor molecule. With this method an about 3-fold half-life extension was seen in a rat PK model over free FVIII. The present invention provides a covalent complex of von Willebrand Factor or variants thereof (VWF) and Factor VIII, in particular using methods to increase the half-life of the VWF-component in the complex, which allows the provision of stable complexes having a prolonged half-life which are advantageous in therapy and prophylaxis of bleeding disorders.

SUMMARY OF THE INVENTION

In a first aspect the present invention relates to a covalent complex comprising von Willebrand factor or variants thereof (VWF) and Factor VIII (FVIII) or variants thereof (Factor VIII), wherein the complex is modified such that it has an extended half-life in vivo. Preferably it is modified to comprise a half-life extending moiety. The VWF and the Factor VIII form a covalent complex; attached to any part of this complex, preferably to the VWF moiety, is a half-life extending moiety. Preferably, the VWF and the Factor VIII are linked by a direct covalent bond, e.g. via a disulphide bridge of a cysteine that is part of the VWF with a cysteine that is part of the Factor VIII, or by fusing VWF with Factor VIII, optionally via a peptide linker, with the proviso that the covalent complex is not an Fc fusion protein, where one of the Fc chains is fused to VWF and the other Fc chain is fused to FVIII or variants thereof. Preferably, the covalent link is not provided by the half-life extending moiety.

In a first embodiment, Factor VIII is modified so that it forms a disulphide bridge with VWF (with the proviso that the disulphide bridge is not between the two chains of an Fc molecule that are fused to VWF and Factor VIII respectively). Preferably, Factor VIII is modified by substitution of a naturally occurring amino acid with a cysteine residue or by insertion of a cysteine residue that forms a disulphide bridge with a cysteine residue in VWF. Preferably, the naturally occurring amino acid that is substituted in Factor VIII is selected from an amino acid in the a3 domain, or a cysteine residue is inserted into the a3 domain (residues 1649 to 1689 of SEQ ID No. 6). More preferably, the naturally occurring amino acid is an acidic residue, preferably a conserved acidic residue, or a residue involved in a hemophilic phenotype, or a Tyr residue which may be sulphated in the FVIII a3 domain. More preferably, the naturally occurring amino acid that is substituted in Factor VIII is located within amino acids 1653 to 1660 or within amino acids 1667 to 1674 or within amino acids 1675 to 1688 of the Factor VIII a3 domain or a cysteine is introduced into the sequence of amino acids 1653 to 1660 or amino acids 1667 to 1674 or amino acids 1675 to 1688 of the Factor VIII a3 domain. Even more preferably, the naturally occurring amino acid in the Factor VIII a3 domain that is substituted with cysteine is selected from T1653, L1655, D1658, E1660, S1669, V1670, N1672, K1673, K1674, E1675, D1676 and/or N1685, in SEQ ID NO: 6 or equivalent position in a genetically engineered form of Factor VIII.

Most preferably, the naturally occurring amino acid in the a3 domain that is substituted with cysteine is selected from T1654, Q1656, F1677, D1678, I1679, Y1680, D1681, E1682, D1683, E1684, Q1686, S1687 and/or P1688 in SEQ ID NO: 6 or equivalent position in a genetically engineered form of Factor VIII.

In another embodiment, a cysteine residue is inserted in the C-terminal domain, or the naturally occurring amino acid that is substituted with cysteine is in the C-terminal domain of Factor VIII, preferably the residue is selected from I2098, S2119, N2129, R2150, P2153, W2229, Q2246 in SEQ ID NO: 6 or equivalent position in an engineered form of Factor VIII.

In a further, preferred embodiment of the first aspect of the invention, VWF is also modified by substitution of a naturally occurring amino acid with a cysteine residue or the insertion of a cysteine residue which forms a disulphide bridge with a cysteine residue introduced into Factor VIII. Preferably, a cysteine residue is inserted into the D' or D3 domain (see FIGS. 2A and 2B), or the naturally occurring amino acid in VWF that is substituted with a cysteine residue is a residue in the D' or D3 domain or a basic or a highly conserved residue in the D' or D3 domain or a residue involved in type N-VWD or an amino acid exposed on the surface of the VWF molecule. In a preferred embodiment of the invention a cysteine residue is inserted into the TIL' domain, the E' domain, the VWD3 domain, the C8-3 domain, the TIL-3 domain or the E-3 domain or the naturally occurring amino acid in VWF that is substituted with a cysteine residue is a residue in the TIL' domain, the E' domain, the VWD3 domain, the C8-3 domain, the TIL-3 domain or the E-3 domain (all as defined by Zhou et al (2012) Blood 120 (2), 449-458). For example, the naturally occurring amino acid in VWF is selected from K773, G785, E787, A/T789, K790, T791, Q793, N794, M800, R820, R826, F830, H831, K834, E835, P838, K843, R852, R854, K855, W856, H861, H874, K882, L884, R906, K912, H916, K920, K923, R924, K940, R945, K948, H952, R960, K968, R976, H977, K985, K991, K1026, R1035, K1036, K1052, Q1053, K1073 or H1074. Preferably, the naturally occurring amino acid in VWF is selected from Y795, R816, H817, P828, D853, D879, K922, D951, E1078, E1161, and/or R1204 in SEQ ID NO: 2 or equivalent position in an engineered form of VWF. More preferably, the naturally occurring amino acid in VWF is selected from R768, R782, H817, D853, E933, L984, E1015, D1076, E1078, P1079, K1116 and/or N1134 in SEQ ID NO: 2 or equivalent position, e.g. in an engineered form of VWF.

More preferably, one or more of the following combinations of substitutions of naturally occurring amino acid residues in VWF and FVIII are introduced:
A/T789C:D1658C, M800C:D1658C, P828C:D1658C, F830C:D1658C, P838C:D1658C, D853C:D1658C, R924C:D1658C, E1078C:D1658C, F830C:D1663C, P838C:D1663C, D853C:D1663C, E1078C:D1663C, E1078C:Y1664C, P838C:D1665C, R816C:D1666C, F830C:D1666C, E835C:D1666C, T791C:E1671C, F830C:E1671C, E835C:E1671C, D879C:E1671C, A/T789C:E1675C, T791C:E1675C, N794C:E1675C, P828C:E1675C, F830C:E1675C, E835C:E1675C, P838C:E1675C, D879CE1675C, R924C:E1675C, E1078C:E1675C, A/T789C:D1676C, T791C:D1676C, N794C:D1676C, F830C:D1676C, E835C:D1676C, A/T789C:D1678C, F830C:D1678C, E835C:D1678C, A/T789C:I1679C, M800C:I1679C, F830C:I1679C, E835C:I1679C, R854C:I1679C, D879C:I1679C, A/T789C:Y1680C, T791C:Y1680C, Y795C:Y1680C, M800C:Y1680C, R816C:Y1680C, F830C:Y1680C, E835C:Y1680C, R854C:Y1680C, D879C:Y1680C, A/T789C:E1682C, Y795C:E1682C, R816C:E1682C, P828C:E1682C, E835C:E1682C, P838C:E1682C, R854C:E1682C, D879C:E1682C, Q1053C:E1682C.

Even more preferably, one or more of the following combinations of substitutions of naturally occurring amino acid residues in VWF and FVIII are introduced:
F1677C:R768C, I1679C:R768C, Y1680C:R768C, N1685C:R768C, T1654C:R782C, E1675C:R782C, N1685C:R782C, Q1686C:Y795C, S1687C:Y795C, P1688C:Y795C, P1688C:Y795C, E1675C:H816C, D1676C:R816C, Y1680C:R816C, E1682C:R816C, P1688C:R816C, Y1680C:H817C, N1685C:H817C, Q1686C:H817C, S1687C:H817C, I1679C:P828C, Y1680C:D853C, N1685C:D853C, T1654C:D879C, P1688C:E933C, P1688:T951C, T1653C:L984C, T1654C:L984C, L1655C:L984C, S1669C:L984C, K1673C:L984C, D1683C:L984C, T1653C:E1015C, L1655C:E1015C, S1669C:E1015C, V1670C:E1015C, N1672C:E1015C, K1673C:E1015C, D1678C:E1015C, I1679C:E1015C, E1684C:E1015C, S1687C:E1015C, F1677C:V1027C, I1679C:V1027C, P1688C:V1027C, S1657C:D1076C, K1673C:D1076C, D1676C:D1076C, F1677C:D1076C, I1679C:D1076C, E1682C:D1076C, D1683C:D1076C, Q1686C:D1076C, D1676C:E1078C, I1679C:E1078C, Y1680C:E1078C, T1653C:P1079C, L1655C:P1079C, S1657C:P1079C, D1658C:P1079C, E1682C:P1079C, V1670C:K1116C, K1673C:K1116C, D1676C:K1116C, D1678C:K1116C, D1681C:K1116C, Q1686C:K1116C, P1688C:K1116C, T1653C:N1134C, L1655C:N1134C, E1660C:N1134C, D1678C:N1134C, D1683C:N1134C, E1684C:N1134C, Q1686C:N1134C, T1653C:E1161C, L1655C:E1161C, K1674C:E1161C, D1676C:E1161C, E1684C:E1161C, S1687C:E1161C, P1688C:R1204C.

Most preferably, one or more of the following combinations of substitutions of naturally occurring amino acid residues in FVIII and VWF are introduced:
T1654:P1079, T1654:N1134, Q1656:D1076, F1677:K1116, D1678:R782, I1679:K1116, Y1680:H817, Y1680:D853, Y1680:E1078, D1681:R768, E1682:R768, D1683:R768, E1684:R768, Q1686:R768, Q1686:E1015, S1687:R768, S1687:N1134, P1688:R768, P1688:H817, P1688:E933, P1688:L984, P1688:E1015, P1688:D1076 and P1688: N1134.

Preferably, the naturally occurring amino acids of the combination of one or more inserted cysteine residues in VWF and Factor VIII are selected by a relative ratio higher than 0.5 of covalently bound Factor VIII to VWF as experimentally assessed shown in example 6 and activity of Factor VIII as experimentally assessed shown in example 9. Most preferably, the naturally occurring amino acids of the combination of one or more inserted cysteine residues in VWF and Factor VIII are selected by a said ratio of higher than 1.0.

Preferably, the Factor VIII in the complex of the invention is a genetically engineered Factor VIII. The engineered Factor VIII may have a partial or complete B-domain deletion, it may be a mutated Factor VIII comprising one or more amino acid substitutions, insertions, deletions or combinations thereof, or it may be a fusion polypeptide with a half-life extending moiety or a chemically modified Factor VIII e.g. modified by attachment of a half-life extending moiety such as polyethylene glycol (PEGylation), glycosylated PEG, hydroxyl ethyl starch (HESylation), polysialic acids, elastin-like polypeptides, heparosan polymers or hyaluronic acid.

In a preferred embodiment, the VWF in the complex of the invention is a half-life extended form of VWF, preferably it is a genetically engineered form of VWF. More preferably, the genetically engineered VWF is a fusion protein of VWF with a half-life extending moiety. Preferably, the half-life extending moiety is a half-life extending polypeptide (HLEP), more preferably HLEP is selected from albumin or fragments thereof, immunoglobulin constant region and portions thereof, e.g. the Fc fragment, solvated random chains with large hydrodynamic volume (e.g. XTEN (Schellenberger et al. 2009), homo-amino acid repeats (HAP) or proline-alanine-serine repeats (PAS)), afamin, alpha-fetoprotein, Vitamin D binding protein, transferrin or variants thereof, carboxyl-terminal peptide (CTP) of human chorionic gonadotropin-β subunit, polypeptides or lipids capable of binding under physiological conditions to albumin or immunoglobulin constant regions. In another preferred embodiment, the VWF of the complex is expressed as a dimer. In a further preferred embodiment, the VWF of the complex forms multimers.

In another embodiment of the invention, the half-life of the complex of the invention is extended by chemical modification, e.g. attachment of a half-life extending moiety such as polyethylene glycol (PEGylation), glycosylated PEG, hydroxyl ethyl starch (HESylation), polysialic acids, elastin-like polypeptides, heparosan polymers or hyaluronic acid.

A second embodiment of the invention is a covalent complex comprising VWF and Factor VIII, wherein the complex is modified such that it has an extended half-life in vivo, and wherein Factor VIII is modified to comprise one or more VWF domains. Preferably, the extended half-life of the complex is obtained by using a half-life extended form of VWF in the complex.

Preferably, the Factor VIII is fused with one or more of the C-terminal domains of VWF (see FIGS. 4A-4J), preferably the one or more C-terminal domains of VWF are fused to the C-terminus of Factor VIII. Such C-terminal domains of VWF comprise the C-terminal cystine knot (CK) domain of VWF and may additionally comprise, besides C or CK domains, one or more additional domains of VWF, e.g. A or D domains. More preferably, the FVIII comprises, preferably at its C-terminus, residues 2723-2813, 2724-2813, 2722-2813, 2578-2813, 2580-2813, 2497-2813, 2429-2813, 2400-2813, 2334-2813, 2255-2813, 1873-2813, 1683-2813, 1277-2813, 1264-2813 or 764-2813 of SEQ ID NO: 2 or variants thereof, provided that cysteine residue 2773 (or equivalent thereof) is preserved.

Preferably, the C-terminal CK domain of VWF, optionally comprising further VWF domains as disclosed above, is attached to FVIII by a cleavable linker. More preferably, the cleavable linker comprises a cleavage site cleavable by proteases related to blood coagulation, even more preferably, the cleavable linker comprises a thrombin cleavage site, preferably one of the thrombin cleavage sites of FVIII. Preferably, the linker sequence also comprises additional amino acid residues, preferably the additional amino acid residues are inserted between the C-terminal domain(s) of VWF and the cleavable part of the linker. Preferably, the additional amino acid residues provide a peptide of sufficient length to permit the interaction of FVIII and VWF via the a3 region of FVIII and the D'D3 regions of VWF, respectively. The additional amino acid residues may be more than 10, 20, 30, 40, 50, 60, 70, 80, 90, 100, 120 or 150 amino acids. Preferably the additional amino acid residues form a flexible, "non-structural" peptide, and more preferably comprise or even consist of glycine-serine repeats, proline-alanine-serine repeats, homo-amino acid repeats, or sequences of the FVIII B-domain.

In another embodiment, the Factor VIII is N-terminally fused with one or more of the C-terminal domains of VWF. Such C-terminal domains may be derived from the C-terminal cystine knot (CK) domain of VWF and may additionally comprise one or more further domains of VWF. More preferably, the Factor VIII comprises, preferably at its N-terminus, residues 2723-2813, 2724-2813, 2722-2813, 2580-2813, 2578-2813, 2497-2813, 2429-2813, 2400-2813, 2334-2813, 2255-2813, 1873-2813, 1683-2813, 1277-2813, 1264-2813 or 764-2813 of SEQ ID NO: 2 or variants thereof, provided that cysteine residue 2773 (or equivalent thereof) is preserved. For these embodiments, the expression product would comprise, from N- to C-terminus, a signal peptide, the CK domain of VWF, optionally with additional domains of VWF, preferably a cleavable (optionally flexible) linker, and Factor VIII.

Another embodiment of the invention is a covalent complex comprising VWF and Factor VIII, wherein the VWF is a half-life extended form of VWF, and wherein Factor VIII is modified to comprise the D'D3 or D1D2D'D3 region of VWF, or fragments thereof which maintain at least 10% of the FVIII binding activity of wild-type von Willebrand Factor. Preferably, the Factor VIII is so modified that its partial or complete B-domain is replaced by the VWF D'D3 region or fragments thereof (see FIGS. 5A-5E). More preferably, the Factor VIII comprises, preferably instead of its (or part of its) B domain, residues 764 to 1241, 764 to 1242, 764 to 1247, 764 to 1270 or any sequence between 764 and 1241 to 1270, respectively, of SEQ ID NO: 2 or a variant or a fragment thereof.

Figure 5A:
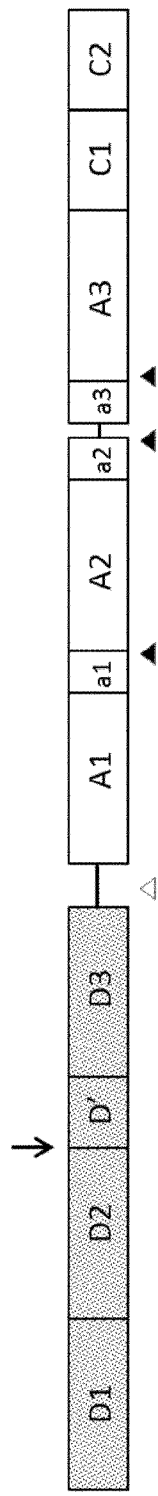
Figure 5B:
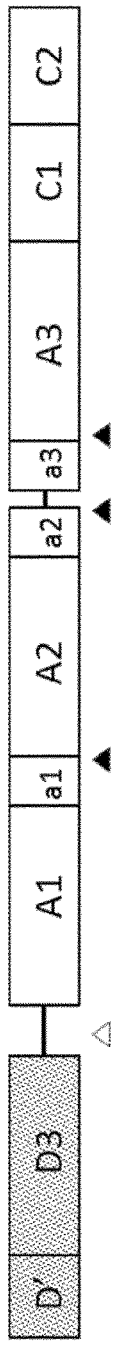
Figure 5C:
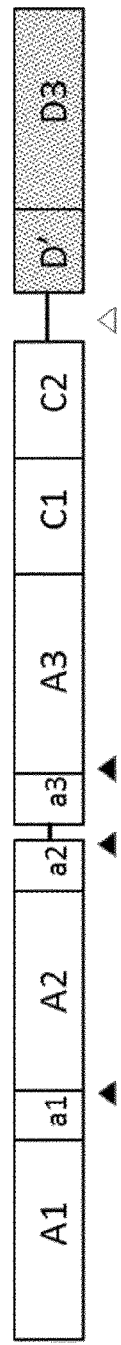
Figure 5D:
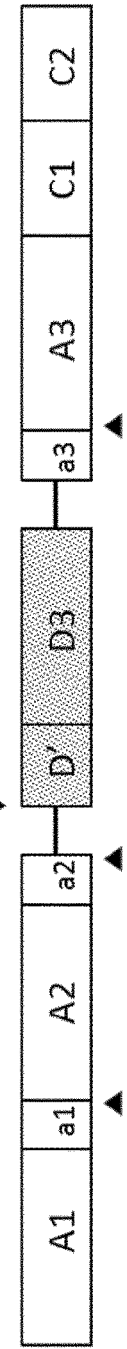
Figure 5E:
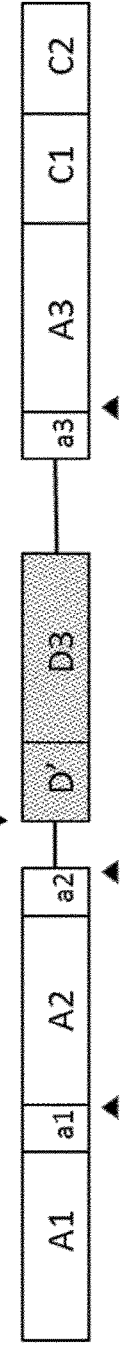

In a preferred embodiment, the D'D3 domain of VWF is attached to Factor VIII such that a two-chain molecule is generated upon secretion of the molecule into the cell culture medium and that the D'D3 domain is located at the N-terminus of the Factor VIII light chain. This can be achieved by introducing a cleavable linker comprising, for example, a cleavage site for PACE/furin between the Factor VIII a2 domain or the remainders of the B domain and the VWF D'D3 domain (FIGS. 5D and 5E). Preferably, the linker comprises additional residues between the D'D3 domain of VWF and the Factor VIII a3 domain, the additional residues comprising a peptide of sufficient length to permit the intramolecular interaction of Factor VIII and VWF via the a3 and D'D3 domains, respectively (FIG. 5E). Preferably, the additional residues comprise less than 200 amino acids, more preferably less than 100 amino acids, even more preferably less than 90, 80, 70, 60, 50 amino acids, less than 40 amino acids, less than 30 amino acids, less than 20 amino acids, most preferably less than 10 amino acids. Preferably the additional residues comprise a flexible, "non-structural" peptide, more preferably they comprise or even consist of glycine-serine repeats, proline-alanine-serine repeats or homo-amino acid repeats. The protein to be expressed to obtain the mature form as described may be constructed to include additional sequences, e.g. a signal sequence at the N-terminus.

Alternatively, the N-terminus of Factor VIII is connected to the C-terminus of the VWF D'D3 domains or fragments thereof, which is preferably N-terminally extended by further domains of VWF (e.g. the D1 and D2 domains); this will aid in the expression and intracellular formation of covalent bonds with half-life extended VWF. More preferably, the Factor VIII comprises N-terminally residues 1 to 1241 or residues 764 to 1241 (after cleavage of the propeptide) of SEQ ID NO: 2 or a variant or a fragment thereof.

Preferably, the D'D3 or D1D2D'D3 domains of VWF, respectively, are attached to the N-terminus of Factor VIII by a cleavable linker. More preferably, the cleavable linker comprises a cleavage site cleavable by a protease related to blood coagulation, even more preferably, the cleavable linker comprises a thrombin cleavage site, preferably one of the thrombin cleavage sites of FVIII. Preferably, the linker comprises additional residues between the D'D3 or D1D2D'D3 domains of VWF and the Factor VIII molecule, the additional residues comprising a peptide of sufficient length to permit the interaction of Factor VIII and VWF via the a3 and D'D3 regions, respectively (FIG. 5E). Preferably, more than 20, 30, 50, 100, or 150 additional amino acids are added. Preferably the additional amino acids comprise a flexible, non-structural peptide, more preferably they comprise or even consist of glycine-serine repeats, proline-alanine-serine repeats, homo-amino acid repeats, or sequences of the FVIII B-domain.

Furthermore, the D'D3 or D1D2D'D3 domains of VWF fused to the N-terminus of FVIII via a linker as described above may be extended between D3 and the described linker by additional VWF domains derived from VWF should further VWF-related functionalities be incorporated into the construct.

A second aspect of the invention is a method of producing the covalent complex of Factor VIII and VWF described above, comprising co-expressing the Factor VIII and VWF molecules in a eukaryotic cell line. Preferably, the eukaryotic cell line is modified to express PACE/furin to ensure efficient processing. Alternatively, the proteins (Factor VIII and VWF) may be produced separately and then combined in vitro, e.g. in a moderately oxidizing environment to enable disulphide bridge formation, but leaving intact the functionalities of Factor VIII and VWF.

Figure 7:
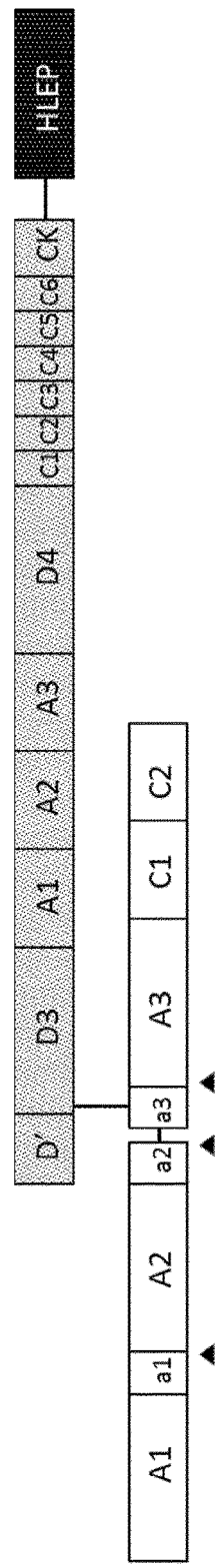

In another embodiment of this aspect of the invention the (modified) Factor VIII and the (modified) VWF are covalently connected by chemical crosslinking (see FIG. 7).

A third aspect of the invention is a covalent complex as described above for use in medicine, preferably for use in the treatment or prophylaxis of a bleeding disorder. Preferably, the bleeding disorder is hemophilia A or VWD.

A fourth aspect of the invention is a pharmaceutical composition comprising the covalent complex described above.

A further aspect of the invention is a method of treating or preventing a bleeding disorder by administering an effective amount of a complex described above to a subject in need thereof.

DETAILED DESCRIPTION OF THE INVENTION

As mentioned above, it would be highly beneficial to have a FVIII with a long half-life for the chronic treatment of patients with haemophilia, in particular with haemophilia A. The inventors have now surprisingly found that a covalent complex of von Willebrand factor (VWF) and FVIII can be produced, which provides a longer half-life for FVIII. In particular when the complex is modified to extend its half-life in vivo, e.g. when a half-life extended form of VWF or of FVIII is used, the half-life of FVIII is significantly enhanced, making this an attractive approach for an improved prophylaxis and treatment of patients with bleeding disorders such as haemophilia A. Preferably, in vivo recovery may also be increased by this approach.

Therefore, in a first aspect the present invention relates to a covalent complex comprising von Willebrand factor or variants thereof (VWF) and Factor VIII or variants thereof (Factor VIII), wherein the complex is modified such that it has an extended half-life in vivo. For example, VWF may be a half-life-extended form of VWF; alternatively (or additionally) Factor VIII may be a half-life extended form of FVIII, or a half-life-extending moiety may be attached to the covalent complex via a linker. Preferably, the VWF in the complex comprises a half-life extending moiety. Preferably, the covalent complex is not a heterodimeric Fc fusion with one Fc monomer linked to VWF and the other Fc monomer linked to Factor VIII. More preferably, the covalent link is not provided by the half-life extending moiety.

The term "von Willebrand Factor" or "VWF", as used herein, refers to any polypeptide having a biological activity of wild type VWF, including variants such as VWF with one or more amino acid substitutions, insertions, minor or major deletions (e.g. deletions of one or more domains), or fusion proteins thereof with another peptide or protein moiety, e.g. a half-life increasing polypeptide, or non-protein moiety, as long as at least a partial activity of von Willebrand Factor is retained. VWF activity may be collagen binding activity, and/or platelet binding activity, and/or FVIII binding activity. FVIII binding activity would be determined for the VWF without FVIII covalently bound via the binding sites on VWF. Assays to measure VWF activity are well established, for example collagen binding assays, Ristocetin cofactor activity assays, or FVIII binding assays. The biological activity is retained in the sense of the invention if the VWF with deletions and/or other modifications retains at least 10%, preferably 15%, 20%, 25%, or 30%, more preferably at least 40% or 50%, even more preferably at least 60%, 70% or 75% of any activity measured for the wild-type VWF. The term "Factor VIII binding domain" refers to a fragment or portion of VWF that retains at least 10%, preferably 15%, 20%, 25%, or 30%, more preferably at least 40% or 50%, even more preferably at least 60%, 70% or 75% of the Factor VIII binding activity of wild type von Willebrand Factor. A Factor VIII binding domain is located at the N-terminus of the mature VWF, for example in the D'D3 domain or fragments thereof.

The gene encoding wild type von Willebrand Factor is transcribed into a 9 kb mRNA which is translated into a pre-propolypeptide of 2813 amino acids with an estimated molecular weight of 310,000 Da. The pre-propolypeptide contains a 22 amino acid long signal peptide, a 741 amino acid pro-polypeptide and the mature subunit. Cleavage of the 741 amino acid long propolypeptide from the N-terminus results in mature VWF consisting of 2050 amino acids. The amino acid sequence of the VWF pre-propolypeptide is shown in SEQ ID NO: 2, and several variants are published, for example NCBI reference sequence NP_000543.2. Unless indicated otherwise, the amino acid numbering of VWF residues in this application refers to SEQ ID NO:2, even though the VWF molecule does not need to comprise all residues of SEQ ID NO:2. The amino acid sequence of mature wildtype VWF corresponds to residues 764 to 2813 of SEQ ID NO: 2. The term "VWF" as used herein refers to any form of VWF or variant thereof that shows at least a partial VWF activity of any one VWF function mentioned above.

The propolypeptide of wild type VWF comprises multiple domains which are arranged in the following order (domain structure of pro-VWF domains D1 to D4 according to Schneppenheim and Budde (2011) J Thrombosis Haemostasis 9 (Suppl. 1) 209-215, domain structure and nomenclature of C-domains according to Zhou et al (2012) Blood 120, 449-458):

D1-D2-D'-D3-A1-A2-A3-D4-C1-C2-C3-C4-C5-C6-CK

The D1 and D2 domains represent the propeptide which is cleaved off to yield the mature VWF. The D' domain encompasses amino acids 764 to 865 of SEQ ID NO:2; the D'D3 domain encompasses amino acids 764 to 1241, 764 to 1242, 764 to 1247, or 764 to 1270, or any sequence between 764 and 1241 to 1270, respectively, of SEQ ID NO: 2. The carboxy-terminal 90 residues comprise the "CK" domain that is homologous to the "cystine knot" superfamily of proteins. These family members have a tendency to dimerize through disulfide bonds. The C-terminal domains C1 to C6 as defined by Zhou et al correspond to residues 2255 to 2333 (C1), 2334 to about 2402 (C2), 2429 to 2496 (C3), 2497 to 2577 (C4), 2578 to 2646 (C5), and 2647 to 2722 (C6) in SEQ ID NO: 2.

Wild type von Willebrand Factor comprises the amino acid sequence of mature von Willebrand Factor as shown in SEQ ID NO: 2, residues 764 to 2813. Also encompassed are additions, insertions, N-terminal, C-terminal or internal deletions of VWF as long as a biological activity of VWF is retained. The biological activity is retained in the sense of the invention if the VWF with deletions and/or other modifications retains at least 10%, preferably 15%, 20%, 25%, or 30%, more preferably at least 40% or 50%, even more preferably at least 60%, 70% or 75% of any activity measured for the wild-type VWF. The biological activity of wild-type VWF can be determined by the skilled person, for example, using methods for measuring ristocetin co-factor activity (Federici A B et al. 2004. Haematologica 89:77-85), binding of VWF to GP Ibα of the platelet glycoprotein complex Ib-V-IX (Sucker et al. 2006. Clin Appl Thromb Hemost. 12:305-310), or a collagen binding assay (Kallas & Talpsep. 2001. Annals of Hematology 80:466-471), or measuring collagen binding, e.g. by surface plasmon resonance. Other methods of determining biological activity of VWF that may be used comprise the determination of FVIII binding capacity (Veyradier et al., Haemophilia 2011).

The terms "blood coagulation Factor VIII", "Factor VIII" and "FVIII" are used interchangeably herein. "Blood coagulation Factor VIII" or "Factor VIII" includes wild-type blood coagulation FVIII as well as derivatives or variants of wild-type blood coagulation FVIII where the procoagulant activity of wild-type blood coagulation FVIII is at least partially retained. Derivatives may have deletions like that of the B domain or parts of the B domain, insertions and/or additions compared with the amino acid sequence of wild-type FVIII. The term Factor VIII includes proteolytically processed forms of FVIII, e.g. the two-chain form before activation, comprising heavy chain and light chain, as well as uncleaved, single-chain Factor VIII.

The term "Factor VIII" includes any FVIII variants or mutants that retain at least 10%, preferably at least 15%, 20% or 25%, more preferably at least 30%, 40% or 50%, most preferably at least 60%, 70% or even 75% of the biological activity of wild-type FVIII.

FVIII is synthesized as a single polypeptide chain with a molecular weight of about 280 kDa. The amino-terminal signal peptide is removed upon translocation of FVIII into the endoplasmatic reticulum, and the mature (i.e. after the cleavage of the signal peptide) native FVIII molecule is then proteolytically cleaved in the course of its secretion between the B and a3 domain or within the B-domain. This results in the release of a heterodimer which consists of a C-terminal light chain of about 80 kDa in a metal ion-dependent association with an N-terminal heavy chain fragment of about 90-200 kDa (see also review by Kaufman, Transfusion Med. Revs. 6:235 (1992)).

Physiological activation of the heterodimer occurs through proteolytic cleavage of the protein chains by thrombin. Thrombin cleaves the heavy chain to a 90 kDa protein, and then to 54 kDa and 44 kDa fragments. Thrombin also cleaves the 80 kDa light chain to a 72 kDa protein. It is the latter protein, and the two heavy chain fragments (54 kDa and 44 kDa above), held together by calcium ions, that constitute active FVIII. Inactivation occurs when the 44 kDa A2 heavy chain fragment dissociates from the molecule or when the 72 kDa and 54 kDa proteins are further cleaved by thrombin, activated protein C or FXa. In plasma, FVIII is stabilized by association with an about 50-fold molar excess of von Willebrand Factor protein ("VWF"), which appears to inhibit proteolytic degradation of FVIII as described above.

The amino acid sequence of FVIII is organized into three structural domains: a triplicated A domain of 330 amino acids each, a single B domain of 980 amino acids, and a duplicated C domain of 150 amino acids each. The B domain has no homology to other proteins and provides 18 of the 25 potential asparagine(N)-linked glycosylation sites of this protein. The B domain has apparently no function in coagulation and can be deleted, with the B-domain deleted FVIII molecule still having procoagulatory activity.

As non-limiting examples, Factor VIII as used herein includes FVIII mutants providing reduced or prevented APC cleavage (Amano 1998. Thromb. Haemost. 79:557-563), FVIII mutants with a further stabilized A2 domain (WO 97/40145), FVIII mutants resulting in increased expression (Swaroop et al. 1997. JBC 272:24121-24124), FVIII mutants with reduced immunogenicity (Lollar 1999. Thromb. Haemost. 82:505-508), FVIII reconstituted from independently expressed heavy and light chains (Oh et al. 1999. Exp. Mol. Med. 31:95-100), FVIII mutants with reduced binding to receptors leading to catabolism of FVIII like HSPG (heparan sulfate proteoglycans) and/or LRP (low density lipoprotein receptor related protein) (Ananyeva et al. 2001. TCM, 11:251-257), disulfide bond-stabilized FVIII variants (Gale et al., 2006. J. Thromb. Hemost. 4:1315-1322), FVIII mutants with improved secretion properties (Miao et al., 2004. Blood 103:3412-3419), FVIII mutants with increased cofactor specific activity (Wakabayashi et al., 2005. Biochemistry 44:10298-304), FVIII mutants with improved biosynthesis and secretion, reduced ER chaperone interaction, improved ER-Golgi transport, increased activation or resistance to inactivation and improved half-life (summarized by Pipe 2004. Sem. Thromb. Hemost. 30:227-237), and single-chain FVIII mutants not cleavable by furin. All of these FVIII mutants and variants are incorporated herein by reference in their entirety.

Preferably Factor VIII comprises the full length sequence of FVIII as shown in SEQ ID NO: 6, more preferably, the Factor VIII is a variant of FVIII with a partial or full deletion of the B-domain. Also encompassed are additions, insertions, substitutions, N-terminal, C-terminal or internal deletions of FVIII as long as the biological activity of FVIII is at least partially retained. The biological activity is retained in the sense of the invention if the FVIII with modifications retains at least 10%, preferably at least 15%, 20% or 25%, more preferably at least 30%, 40% or 50%, most preferably at least 60%, 70% or even 75% of the biological activity of wild-type FVIII. The biological activity of Factor VIII can be determined by the artisan as described below.

A suitable test to determine the biological activity of Factor VIII is for example the one stage coagulation assay (Rizza et al. 1982. Coagulation assay of FVIII:C and FIXa in Bloom ed. The Hemophilias. NY Churchchill Livingston 1992) or the chromogenic (two-stage) substrate FVIII activity assay (S. Rosen, 1984. Scand J Haematol 33: 139-145, suppl.). The content of these references is incorporated herein by reference.

The amino acid sequence of the mature wild-type form of human blood coagulation FVIII is shown in SEQ ID NO: 6. The reference to an amino acid position of a specific sequence means the position of said amino acid in the FVIII wild-type protein and does not exclude the presence of mutations, e.g. deletions, insertions and/or substitutions at other positions in the sequence referred to. For example, a mutation of residue 2004 referring to SEQ ID NO: 6 does not exclude that in the modified homologue one or more amino acids at positions 1 through 2332 of SEQ ID NO: 6 are missing.

"Factor VIII" and/or "VWF" within the above definition also include natural allelic variations that may exist and occur from one individual to another and FVIII from other mammalian species, e.g. porcine FVIII. "Factor VIII" and/or "VWF" within the above definition further includes variants of FVIII and or VWF. Such variants differ in one or more amino acid residues from the wild-type sequence. Examples of such differences may include conservative amino acid substitutions, i.e. substitutions within groups of amino acids with similar characteristics, e.g. (1) small amino acids, (2) acidic amino acids, (3) polar amino acids, (4) basic amino acids, (5) hydrophobic amino acids, and (6) aromatic amino acids. Examples of such conservative substitutions are shown in the following table 1.

TABLE 1

| (1) | Alanine | Glycine | | |
|---|---|---|---|---|
| (2) | Aspartic acid | Glutamic acid | | |
| (3) | Asparagine | Glutamine | Serine | Threonine |
| (4) | Arginine | Histidine | Lysine | |
| (5) | Isoleucine | Leucine | Methionine | Valine |
| (6) | Phenylalanine | Tyrosine | Tryptophane | |

The term "conserved residue" in FVIII or VWF relates to an evolutionarily conserved residue, i.e. where at the respective position an identical residue or conservative substitution is found in at least two, preferably at least three mammalian sequences.

The term "variant" of FVIII, VWF or domains thereof refers to proteins or domains with at least 50% sequence identity, preferably at least 55%, 60%, 65%, 70%, 75% or 80% sequence identity, more preferably at least 82%, 84%, 85%, 86%, or 88% sequence identity, even more preferably at least 90%, 92%, 94%, 95% sequence identity to the sequence or relevant part of the sequence shown in SEQ ID NO 6 or 2 respectively, provided that the variant retains at least 10%, preferably 15%, 20%, 25%, or 30%, more preferably at least 40% or 50%, even more preferably at least 60%, 70% or 75% of the biological activity of the protein or domain thereof respectively. It is recognized that certain positions may be more suitable to variation than others. For example, variants of the CK domain of VWF will need to retain the cysteine at position 2773 (or equivalent thereof), which appears to be essential for the formation of dimers. Other cysteine residues in the CK domain (Zhou et al (2012) Blood 120, 449-458), and other domains of VWF and also of FVIII, may also be essential.

To determine % sequence identity, the sequences are aligned using a suitable sequence alignment program, such as the GAP program of the GCG suite, using default parameters (Devereux et al (1984) Nucl Acids Res 12, 387). Other programs that can be used to align sequences include FASTA (Lipman & Pearson (1985) Science 227, 1436-1441), BLAST (Altschul et al (1990) J Mol Biol 215, 403-410), and ClustalW (Thompson et al (1994) Nucl Acids Res 22, 4673-4680).

In one embodiment of the invention, the covalent linkage is achieved by a disulphide bridge between a cysteine residue in FVIII, which is introduced into FVIII by genetic engineering, and a cysteine residue in VWF, which can be either a cysteine found in the wild-type VWF sequence, or it can also be introduced at an appropriate location in the VWF sequence by genetic engineering.

Figure 3:
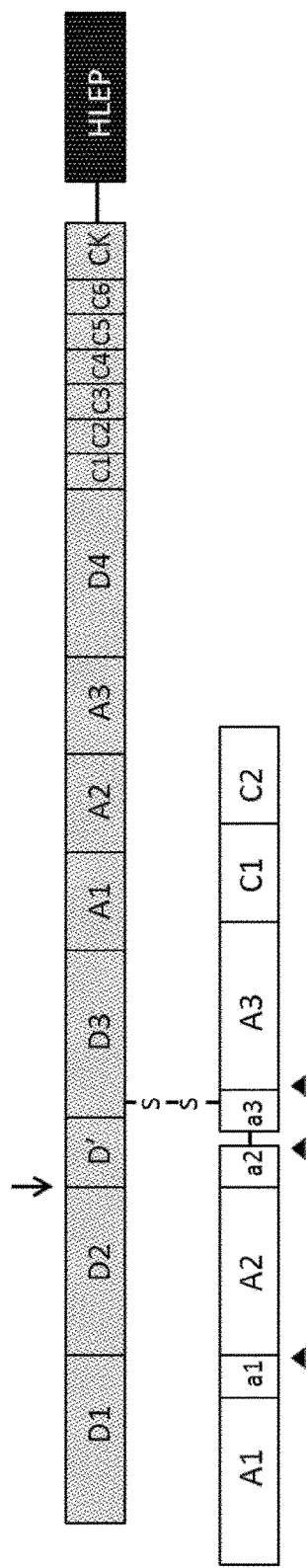
Figure 4F:
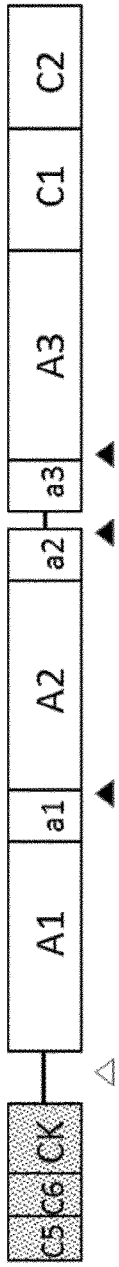
Figure 4G:
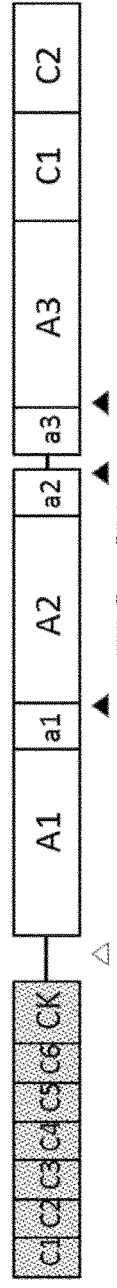
Figure 4H:
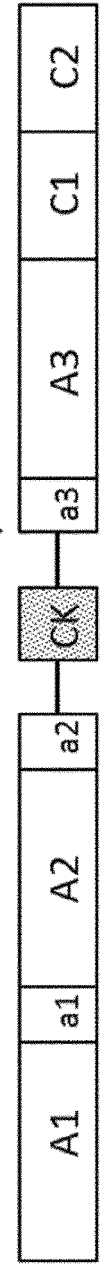
Figure 4I:
Figure 4J:
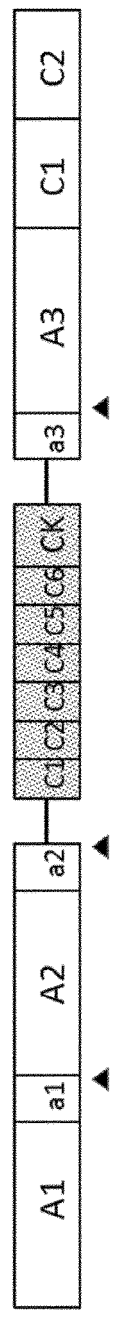

One preferred embodiment of the present invention relates to a covalent complex comprising half-life extended VWF and Factor VIII, wherein Factor VIII is modified by substitution of at least one naturally occurring amino acid with a cysteine residue or insertion of at least one cysteine residue at an appropriate location in the FVIII which forms a disulphide bridge with a cysteine residue in VWF (FIG. 3).

Therefore, according to the invention, the amino acid sequence of the Factor VIII component of the complex differs from that of wild-type FVIII as shown in SEQ ID NO: 6. The modified Factor VIII has at least one mutation, for example a substitution of a naturally occurring amino acid with a cysteine, or an insertion of a cysteine residue at an appropriate position, for example in the a3 domain or the C-terminal domain. Thus there may be one or more, e.g. two, three, four, five or more additional cysteine residues in the Factor VIII of the complex of the invention; more preferably, only one or two additional cysteine residues are introduced, most preferably one additional cysteine residue is introduced.

More preferably, the naturally occurring amino acid that is substituted in Factor VIII is an amino acid in the a3 domain. More preferably, the naturally occurring amino acid that is substituted in Factor VIII is located within amino acids 1653 to 1660 or within amino acids 1667 to 1674 or within amino acids 1675 to 1688 of the FVIII a3 domain. More preferably, the naturally occurring amino acid in the a3 domain is an acidic residue, preferably a conserved acidic residue, or a residue involved in a haemophilic phenotype, or a Tyr residue which may be sulphated in the FVIII a3 domain. Even more preferably, the naturally occurring amino acid in the a3 domain that is substituted with cysteine is selected from E1649, D1658, E1660, D1663, Y1664, D1665, D1666, E1671, E1675, D1676, D1678, I1679, Y1680, E1682, D1683, E1684, even more preferably from T1653, L1655, D1658, E1660, S1669, V1670, N1672, K1673, K1674, E1675, D1676 and/or N1685 in SEQ ID NO: 6 or equivalent position, e.g. in a genetically engineered form of Factor VIII. Most preferably, the naturally occurring amino acid in the a3 domain that is substituted with cysteine is selected from T1654, Q1656, F1677, D1678, I1679, Y1680, D1681, E1682, D1683, E1684, Q1686, S1687 and/or P1688 in SEQ ID NO: 6 or equivalent position, e.g. in a genetically engineered form of FVIII.

Preferably, the naturally occurring amino acid in VWF is selected by a relative ratio higher than 0.5 of covalently bound Factor VIII to VWF as experimentally assessed shown in example 6 and activity of Factor VIII as experimentally assessed shown in example 9. Most preferably, the naturally occurring amino acid in VWF is the selected by a said ratio of higher than 1.0.

In another preferred embodiment of the first aspect of the invention, the naturally occurring amino acid that is substituted with cysteine is in the C-terminal domain of FVIII, preferably an amino acid in the FVIII region between amino acids 2051 and 2270, more preferably the residue is selected from 12098, S2119, N2129, R2150, P2153, W2229, Q2246 in SEQ ID NO: 6 or equivalent position, e.g. in an engineered form of FVIII.

In a further, preferred embodiment of the first aspect of the invention, VWF is also modified by substitution of a naturally occurring amino acid with a cysteine residue, or insertion of a cysteine residue, which forms a disulphide bridge with a cysteine residue introduced into Factor VIII. The naturally occurring amino acid in VWF is a residue within the D' or D3 region, preferably a basic residue in the D' or D3 region or a highly conserved residue in the D' or D3 region or a residue involved in type N-VWD or an amino acid exposed on the surface of the VWF molecule. In a preferred embodiment of the invention a cysteine residue is inserted into the TIL' domain, the E' domain, the VWD3 domain, the C8-3 domain, the TIL-3 domain or the E-3 domain or the naturally occurring amino acid in VWF that is substituted with a cysteine residue is a residue in the TIL' domain, the E' domain, the VWD3 domain, the C8-3 domain, the TIL-3 domain or the E-3 domain (domains as defined by Zhou et al (2012) Blood 120(2) 449-458). For example, the naturally occurring amino acid in VWF is selected from R768, R782, R816, R820, R826, R852, R854, R906, R924, R945, R960, R976, R1035, H817, H831, H861, H874, H916, H952, H977, H1047, K773, K790, K834, K843, K855, K882, K912, K920, K922, K923, K940, K948, K968, K985, K991, K1026, K1036, K1052, K1073, G785, M800, D879, Q1053, E1078, E787, A789, T789, T791, Q793, N794, Y795, P828, F830, E835, P838, D853, W856, L884. Preferably, the naturally occurring amino acid in VWF is selected from T795, R816, D879, D951, E1161, and/or R1204 in SEQ ID NO: 2 or equivalent position, e.g. in an engineered form of VWF. More preferably, the naturally occurring amino acid in VWF is selected from R768, R782, H817, D853, E933, L984, E1015, D1076, E1078, P1079, K1116 and/or N1134 in SEQ ID NO: 2 or equivalent position, e.g. in an engineered form of VWF.

Preferably, the naturally occurring amino acid in VWF is selected by a relative ratio higher than 0.5 of covalently bound FVIII to VWF as experimentally assessed shown in example 6 and activity of Factor VIII as experimentally assessed shown in example 9. Most preferably, the naturally occurring amino acid in VWF is selected by a said ratio higher than 1.0.

Preferably, one or more of the following combinations of substitutions of naturally occurring amino acid residues in FVIII and VWF are introduced:
A/T789C:D1658C, M800C:D1658C, P828C:D1658C, F830C:D1658C, P838C:D1658C, D853C:D1658C, R924C:D1658C, E1078C:D1658C, F830C:D1663C, P838C:D1663C, D853C:D1663C, E1078C:D1663C, E1078C:Y1664C, P838C:D1665C, R816C:D1666C, F830C:D1666C, E835C:D1666C, T791C:E1671C, F830C:E1671C, E835C:E1671C, D879C:E1671C, A/T789C:E1675C, T791C:E1675C, N794C:E1675C, P828C:E1675C, F830C:E1675C, E835C:E1675C, P838C:E1675C, D879CE1675C, R924C:E1675C, E1078C:E1675C, A/T789C:D1676C, T791C:D1676C, N794C:D1676C, F830C:D1676C, E835C:D1676C, A/T789C:D1678C, F830C:D1678C, E835C:D1678C, A/T789C:I1679C, M800C:I1679C, F830C:I1679C, E835C:I1679C, R854C:I1679C, D879C:I1679C, A/T789C:Y1680C, T791C:Y1680C, Y795C:Y1680C, M800C:Y1680C, R816C:Y1680C, F830C:Y1680C, E835C:Y1680C, R854C:Y1680C, D879C:Y1680C, A/1789C:E1682C, Y795C:E1682C, R816C:E1682C, P828C:E1682C, E835C:E1682C, P838C:E1682C, R854C:E1682C, D879C:E1682C, Q1053C:E1682C.

More preferably, one or more of the following combinations of substitutions of naturally occurring amino acid residues in FVIII and VWF are introduced:
F1677C:R768C, I1679C:R768C, Y1680C:R768C, N1685C:R768C, T1654C:R782C, E1675C:R782C, N1685C:R782C, Q1686C:Y795C, S1687C:Y795C, P1688C:Y795C, P1688C:Y795C, E1675C:H816C, D1676C:R816C, Y1680C:R816C, E1682C:R816C, P1688C:R816C, Y1680C:H817C, N1685C:H817C, Q1686C:H817C, S1687C:H817C, I1679C:P828C, Y1680C:D853C, N1685C:D853C, T1654C:D879C, P1688C:E933C, P1688:T951C, T1653C:L984C, T1654C:L984C, L1655C:L984C, S1669C:L984C, K1673C:L984C, D1683C:L984C, T1653C:E1015C, L1655C:E1015C, S1669C:E1015C, V1670C:E1015C, N1672C:E1015C, K1673C:E1015C, D1678C:E1015C, I1679C:E1015C, E1684C:E1015C, S1687C:E1015C, F1677C:V1027C, I1679C:V1027C, P1688C:V1027C, S1657C:D1076C, K1673C:D1076C, D1676C:D1076C, F1677C:D1076C, I1679C:D1076C, E1682C:D1076C, D1683C:D1076C, Q1686C:D1076C, D1676C:E1078C, I1679C:E1078C, Y1680C:E1078C, T1653C:P1079C, L1655C:P1079C, 51657C:P1079C, D1658C:P1079C, E1682C:P1079C, V1670C:K1116C, K1673C:K1116C, D1676C:K1116C, D1678C:K1116C, D1681C:K1116C, Q1686C:K1116C, P1688C:K1116C, T1653C:N1134C, L1655C:N1134C, E1660C:N1134C, D1678C:N1134C, D1683C:N1134C, E1684C:N1134C, Q1686C:N1134C, T1653C:E1161C, L1655C:E1161C, K1674C:E1161C, D1676C:E1161C, E1684C:E1161C, S1687C:E1161C, P1688C:R1204C.

Most preferably, one or more of the following combinations of substitutions of naturally occurring amino acid residues in FVIII and VWF are introduced:
T1654:P1079, T1654:N1134, Q1656:D1076, F1677:K1116, D1678:R782, I1679:K1116, Y1680:H817, Y1680:D853, Y1680:E1078, D1681:R768, E1682:R768, D1683:R768, E1684:R768, Q1686:R768, Q1686:E1015, S1687:R768, 51687:N1134, P1688:R768, P1688:H817, P1688:E933, P1688:L984, P1688:E1015, P1688:D1076 and P1688:N1134.

Preferably, the naturally occurring amino acids of the combination of one or more inserted cysteine residues in VWF and Factor VIII are selected by a relative ratio higher than 0.5 of covalently bound Factor VIII to VWF as experimentally assessed shown in example 6 and activity of Factor VIII as experimentally assessed shown in example 9. Most preferably, the naturally occurring amino acids of the combination of one or more inserted cysteine residues in VWF and Factor VIII are selected by a said ratio of higher than 1.0.

Preferably, the Factor VIII in the complex of the invention is a genetically engineered Factor VIII. The engineered Factor VIII may contain a partial or complete B-domain deletion, it may be a mutated Factor VIII comprising one or more amino acid substitutions, insertions, deletions or combinations thereof, it may be a single chain version of Factor VIII, or it may be a fusion polypeptide with a half-life extending moiety, e.g. a half-life extending polypeptide (HLEP). It may also be a chemically modified Factor VIII, e.g. modified by attachment of a half-life extending moiety such as polyethylene glycol (PEGylation), glycosylated PEG, hydroxyl ethyl starch (HESylation), polysialic acids, elastin-like polypeptides, heparosan polymers or hyaluronic acid. It may also be a Factor VIII from another species, e.g. another mammalian species, e.g. porcine Factor VIII.

Preferably, the VWF in the complex of the invention is a half-life extended form of VWF.

As used herein, the term "half-life" indicates the functional half-life of the respective protein, i.e. the time it takes for half the activity to be lost in vivo, i.e. in blood.

In a preferred embodiment, the half-life extended form of VWF in the complex of the invention is a genetically engineered form of VWF. More preferably, the genetically engineered VWF is a fusion protein of VWF with a half-life extending moiety such as a half-life extending polypeptide (HLEP).

A "half-life enhancing polypeptide" or "half-life extending polypeptide" (HLEP) as used herein is a moiety that is fused to the protein of interest, in particular to VWF, in order to extend its half-life. Preferred HLEPs are selected from the group consisting of albumin, a member of the albumin-family, the constant region of immunoglobulin G and fragments thereof, polypeptides or lipids capable of binding under physiological conditions to albumin, to members of the albumin family as well as to portions of an immunoglobulin constant region. It may be a full-length half-life-enhancing protein described herein (e.g. albumin, a member of the albumin-family or the constant region of immunoglobulin G) or one or more domains or fragments thereof that are capable of stabilizing or prolonging the therapeutic activity or the biological activity of the coagulation factor. Such fragments may be composed of 10 or more amino acids in length or may include at least about 15, at least about 20, at least about 25, at least about 30, at least about 50, at least about 100, or more contiguous amino acids from the HLEP sequence or may include part or all of specific domains of the respective HLEP, as long as the HLEP fragment provides a functional half-life extension of at least 25% compared to a wild-type VWF or Factor VIII.

The HLEP may be a variant of a HLEP. The term "variants" includes insertions, deletions and substitutions, either conservative or non-conservative, where such changes allow the half-life extending properties of the HLEP to be at least partially maintained.

In particular, the proposed VWF HLEP fusion constructs of the invention may include naturally occurring polymorphic variants of HLEPs and fragments of HLEPs. The HLEP may be derived from any vertebrate, especially any mammal, for example human, monkey, cow, sheep, or pig. Non-mammalian HLEPs include, but are not limited to, hen and salmon.

Preferably, the half-life extending moiety is selected from albumin or variants or fragments thereof, immunoglobulin constant region or variants and portions thereof, e.g. the Fc fragment, solvated random chains with large hydrodynamic volume (e.g. XTEN, homo-amino acid repeats (HAP) or proline-alanine-serine repeats (PAS)), afamin or variants thereof, alpha-fetoprotein or variants thereof, Vitamin D binding protein or variants thereof, transferrin or variants thereof, carboxyl-terminal peptide (CTP) of human chorionic gonadotropin-R subunit, polypeptides or lipids capable of binding under physiological conditions to albumin or immunoglobulin constant regions. Most preferably, the HLEP is human serum albumin.

The terms, "human serum albumin" (HSA) and "human albumin" (HA) are used interchangeably in this application. The terms "albumin" and "serum albumin" are broader, and encompass human serum albumin (and fragments and variants thereof) as well as albumin from other species (and fragments and variants thereof).

As used herein, "albumin" refers collectively to albumin polypeptide or amino acid sequences, or an albumin fragment or variant, having one or more functional activities (e.g., biological activities) of albumin such as binding of $Ca^{2+}$, $Na^+$, $K^+$, $Zn^{2+}$ ions, fatty acids, hormones, bilirubin or binding to FcRn. In particular, "albumin" refers to human albumin or fragments thereof, especially the mature form of human albumin as shown in SEQ ID NO: 7 herein or albumin from other vertebrates or fragments thereof, or analogs or variants of these molecules or fragments thereof.

In particular, the proposed VWF fusion constructs of the invention may include naturally occurring polymorphic variants of human albumin and fragments of human albumin. Generally speaking, an albumin fragment or variant will be at least 30, most preferably more than 70 amino acids long. The albumin variant may preferentially consist of or alternatively comprise at least one whole domain of albumin or fragments of said domains, for example domains 1 (amino acids 1-194 of SEQ ID NO:7), 2 (amino acids 195-387 of SEQ ID NO: 7), 3 (amino acids 388-585 of SEQ ID NO: 7), 1+2 (1-387 of SEQ ID NO: 7), 2+3 (195-585 of SEQ ID NO: 7) or 1+3 (amino acids 1-194 of SEQ ID NO: 3+amino acids 388-585 of SEQ ID NO: 7). Each domain is itself made up of two homologous subdomains namely 1-105, 120-194, 195-291, 316-387, 388-491 and 512-585, with flexible inter-subdomain linker regions comprising residues Lys106 to Glu119, Glu292 to Val315 and Glu492 to Ala511.

The albumin portion of the VWF fusion constructs within the complex of the invention may comprise at least one subdomain or domain of HA or conservative modifications thereof.

In a preferred embodiment the N-terminus of albumin is fused to the C-terminus of the amino acid sequence of the modified VWF. That is, the complex of the present invention may comprise the structure:

mVWF-L-A wherein mVWF is the modified VWF as described hereinabove, L is an optional peptidic linker sequence and A is albumin as defined hereinabove.

The modified VWF or the complex of the FVIII with the modified VWF of the invention may comprise more than one HLEP sequence, e.g. two or three HLEP sequences. These multiple HLEP sequences may be fused to the C-terminal part of VWF in tandem, e.g. as successive repeats.

The HLEP may also be coupled to VWF by a peptide linker. The linker should be non-immunogenic and may be a non-cleavable or cleavable linker. Non-cleavable linkers may be comprised, for example, of alternating glycine and serine residues as exemplified in WO2007/090584.

A possible peptidic linker between the VWF moiety and the HLEP moiety may also consist of peptide sequences, which serve as natural interdomain linkers in human proteins. Preferably such peptide sequences in their natural environment are located close to the protein surface and are accessible to the immune system so that one can assume a natural tolerance against this sequence. Examples are given in WO2007/090584. Preferably, the linker region comprises a sequence of VWF, which should result in a decreased risk of neoantigenic properties of the expressed fusion protein.

Cleavable linkers should be flexible enough to allow cleavage by proteases. The linker peptides are preferably cleavable by the proteases of the coagulation system, for example FIIa, FIXa, FXa, FXIa, FXIIa and/or FVIIa.

The HLEP may also be a peptide that can non-covalently bind a half-life extending moiety such as a protein naturally occurring in human plasma (e.g. albumin, immunoglobulins). In this case, VWF would be modified in a way that it bears, preferably C-terminally or N-terminally to the D'D3 domain, a peptide binding the half-life extending moiety.

In another embodiment of the invention, the half-life of VWF is extended by chemical modification, e.g. attachment of a half-life extending moiety such as polyethylene glycol (PEGylation), glycosylated PEG, hydroxyl ethyl starch (HESylation), polysialic acids, elastin-like polypeptides, heparosan polymers or hyaluronic acid.

Another embodiment of the invention is a covalent complex of Factor VIII and half-life extended VWF, where Factor VIII is connected to VWF via an additional peptide or polypeptide sequence added to Factor VIII. Preferably the added sequence comprises one or more VWF domains.

As mentioned above, during biosynthesis in the endoplasmatic reticulum, the VWF propeptide monomers are assembled into dimers via a C-terminal disulphide bridge formed between the C-terminal cystine knot domains (CK). The inventors have now surprisingly found that this CK domain, when fused with Factor VIII, leads to a covalent, disulphide linkage between the CK domains introduced into Factor VIII, and that naturally present in VWF. Thus, this presents another novel way of achieving the covalent complex between Factor VIII and VWF of the present invention. The efficiency with which the covalent linkage is formed can be enhanced if additional C domains are included in the portion of the VWF that is fused to Factor VIII. These may be for example the C5 to C6 domains, the C3 to C6 domains or the C1 to C6 domains as defined by Zhou et al (2012, Blood 120, 449-458), optionally extended by additional VWF domains.

Therefore, another embodiment of the invention is a covalent complex comprising VWF and Factor VIII, wherein the VWF is a half-life extended form of VWF, wherein Factor VIII is modified to comprise the C-terminal domain CK of VWF, optionally containing additional VWF domains. Preferably, the Factor VIII is so modified at its C-terminus. More preferably, the Factor VIII comprises, preferably at its C-terminus, residues 2723 to 2813, 2722-2813, 2724-2813, 2580-2813, 2578-2813, 2497-2813, 2429-2813, 2400-2813, 2334-2813, 2255-2813, 1873-2813, 1683-2813, 1277-2813, 1264-2813 or 764-2813 of SEQ ID NO: 2 or a variant thereof, provided that cysteine residue 2773 (or equivalent thereof) is preserved. Preferably, the modified Factor VIII in addition to the CK domain comprises C6, C5 to C6, C4 to C6, C3 to C6, C2 to C6, or C1 to C6 domains of VWF as defined by Zhou et al (2012, Blood 120, 449-458) or variants thereof. Optionally, the CK and C domains may be extended by additional domains of VWF.

Figure 6A:
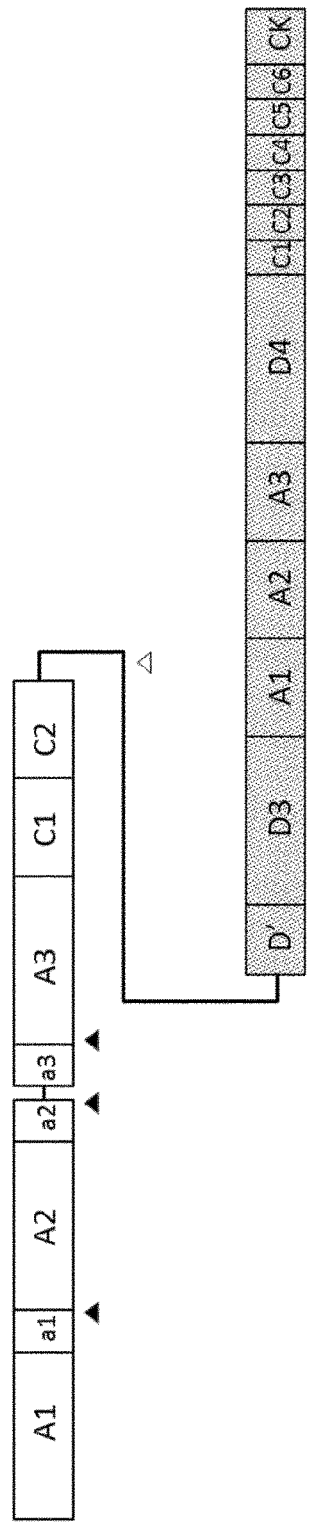
Figure 6B:
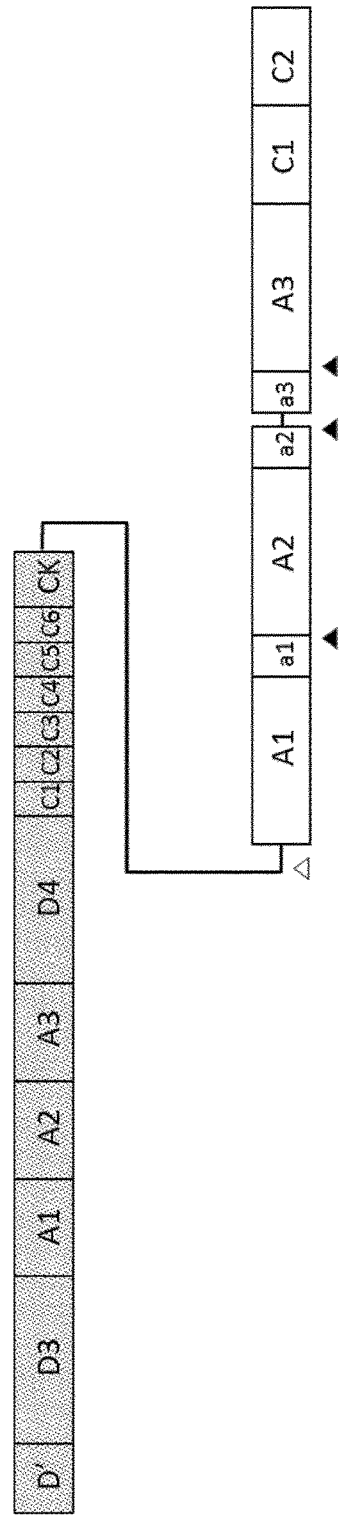
Figure 6C:
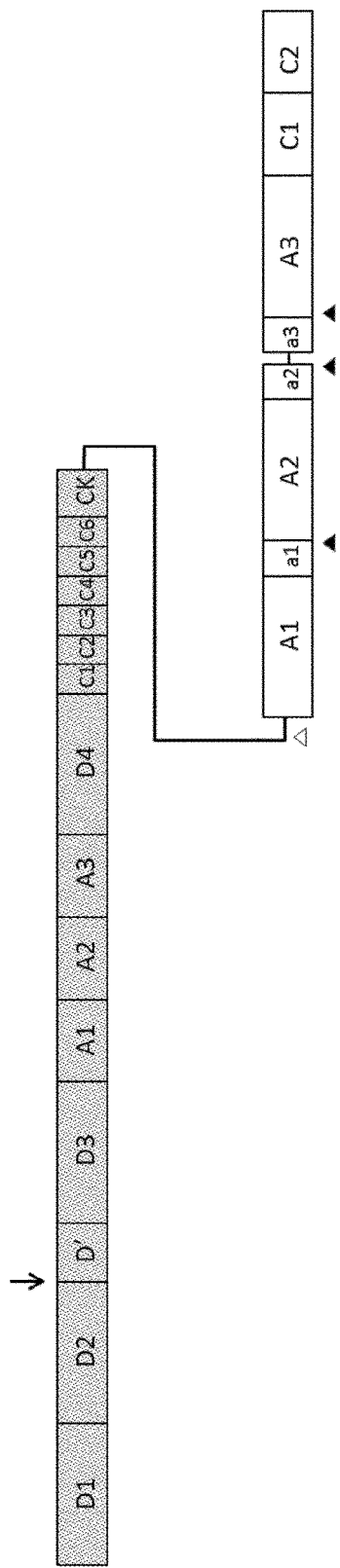

In another embodiment of the invention, the Factor VIII is N-terminally fused with one or more of the C-terminal domains of VWF (see FIGS. 6A-6C). Such C-terminal domains may be derived from the C-terminal cystine knot (CK) domain of VWF and may additionally comprise one or more of the C-domains, D-domains, or A-domains of VWF up to the whole VWF sequence (see FIGS. 2A and 2B for the structure of VWF). More preferably, the Factor VIII comprises, preferably at its N-terminus, residues 2723 to 2813, 2722-2813 2724-2813, 2580-2813, 2578-2813, 2497-2813, 2429-2813, 2400-2813, 2334-2813, 2255-2813, 1873-2813, 1683-2813, 1277-2813 or 1264-2813 or 764-2813 of SEQ ID NO: 2 or variants thereof, provided that cysteine residue 2773 (or equivalent thereof) is preserved. In this embodiment, a signal peptide is added to the N-terminus of the VWF domains, and the VWF domains are fused to the N-terminus of mature Factor VIII (without signal peptide) either directly or via a polypeptide linker.

Preferably, the C-terminal CK domain, optionally extended by additional domains, of VWF is attached to Factor VIII by a cleavable linker. A linker sequence may consist of one or more amino acids, e.g. of 1 to 200, 1 to 150, 1 to 100, 1 to 50, 1 to 30, 1 to 20, 1 to 15, 1 to 10, 1 to 5 or 1 to 3 (e.g. 1, 2 or 3) amino acids and which may be equal or different from each other. Usually, the linker sequences are not present at the corresponding position in the wild-type coagulation factor. Preferably, the linker is a cleavable linker, i.e. it comprises a cleavage site for a protease, preferably it comprises a cleavage site that is cleavable by a protease related to blood coagulation, more preferably, the cleavable linker comprises a thrombin cleavage site, even more preferably it comprises one of the thrombin cleavage sites of FVIII.

Examples of cleavable linkers are

```
(aa1675-1720 of SEQ ID NO: 6 (FVIII))
EDFDIYDEDENQSPRSFQKKTRHYFIAAVERLWDYGMSSSPHVLRN
or (aa714-764 of SEQ ID NO: 6)
NTGDYYEDSYEDISAYLLSKNNAIEPRSFSQNSRHRSTRQKQFNATTIPEN
or (aa357-399 of SEQ ID NO: 6)
VVRFDDDNSPSFIQIRSVAKKHPKTWVHYIAAEEEDWDYAPLV
or (aa357-396 of SEQ ID NO: 6)
VVRFDDDNSPSFIQIRSVAKKHPKTWVHYIAAEEEDWDYA
or (aa357-394 of SEQ ID NO: 6)
VVRFDDDNSPSFIQIRSVAKKHPKTWVHYIAAEEEDWD
```

Including deletions, insertions and/or substitutions thereof, given that cleavability is retained.

Optionally, the linker comprises additional amino acid residues, which are preferably introduced between the domain(s) derived from VWF and the cleavable part of the linker. Preferably, the additional residues provide a peptide of sufficient length to permit the interaction of Factor VIII and VWF, in particular via the a3 and D'D3 regions, respectively. The additional amino acid residues may be more than 10, 20, 30, 40, 50, 60, 70, 80, 90, 100, 120 or 150 amino acids. Preferably the additional amino acid residues form a flexible, "non-structural" peptide, and more preferably comprise or even consist of glycine-serine repeats, proline-alanine-serine repeats, homo-amino acid repeats, or sequences of the FVIII B-domain.

Another embodiment of the invention is a covalent complex comprising VWF and Factor VIII, wherein the VWF is a half-life extended form of VWF, and wherein Factor VIII is modified to comprise the D'D3 region of VWF, and optionally additional domains of VWF (FIGS. 5A-5E). Preferably, the Factor VIII is so modified that its partial or complete B-domain is replaced by the VWF D'D3 region or fragments thereof (FIGS. 5D and 5E). More preferably, the Factor VIII comprises, preferably instead of its (or part of its) B domain, residues 764 to 1241, 764 to 1242, 764 to 1247 or 764 to 1270 or any sequence between 764 and 1241 to 1270, respectively, of SEQ ID NO: 2 or a variant or a fragment thereof.

Preferably, the D'D3 domain of VWF is attached to Factor VIII such that a two-chain molecule is generated upon secretion of the molecule into the cell culture medium and that the D'D3 domain is located at the N-terminus of the Factor VIII light chain. This can be achieved by introducing a cleavable linker, comprising, for example, a cleavage site for PACE/furin, between the Factor VIII a2 domain and the VWF D'D3 domain (FIGS. 5D and 5E). Optionally, the linker comprises additional residues between the D'D3 domain of VWF and the Factor VIII a3 domain (FIG. 5E). The additional residues comprise a peptide of sufficient length to permit the intramolecular interaction of Factor VIII and VWF via the a3 and D'D3 regions, respectively. Preferably, the additional residues are less than 300, 250, 200, 150, 120, 100, 90, 80, 70, 60, 50, 40, 30, 25, 20, 15, or 10 amino acids. The additional amino acid residues may comprise a flexible, "non-structural" peptide, preferably they comprise or even consist of glycine-serine repeats, proline-alanine-serin repeats or homo-amino acid repeats, or sequences derived from the FVIII B-domain.

The embodiments described above are the mature form; the skilled person will be able to construct a protein to be expressed in order to obtain the mature form, e.g. by including additional sequences, e.g. a signal sequence at the N-terminus.

Alternatively, the N-terminus of Factor VIII is connected to the C-terminus of the VWF D'D3 domains or fragments thereof, optionally containing further domains of VWF (e.g. the D1 and D2 domains), which is preferably N-terminally extended by a signal peptide. This will aid in the expression and intracellular formation of covalent bonds with half-life extended VWF. More preferably, the VWF portion comprises N-terminally residues 1 to 1241 or residues 764 to 1241 (after cleavage of the propeptide) of SEQ ID NO: 2 or a variant or a fragment thereof.

Preferably, the D'D3 or D1D2D'D3 domains of VWF, respectively, are attached to the N-terminus of Factor VIII by a cleavable linker. More preferably, the cleavable linker comprises a protease cleavage site, more preferably a cleavage site for one of the proteases of the coagulation system, even more preferably a thrombin cleavage site, preferably one of the thrombin cleavage sites of FVIII. Optionally, the linker comprises additional residues between the D'D3 or D1D2D'D3 domains of VWF and the Factor VIII molecule, the additional residues comprising a peptide of sufficient length to permit the intramolecular interaction of Factor VIII and VWF via the a3 and D'D3 regions, respectively. Preferably, more than 20, 30, 40, 50, 70, 100 or 150 additional amino acids are added. Preferably the additional amino acids comprise a flexible, non-structural peptide, more preferably they comprise or even consist of glycine-serine repeats, proline-alanine-serine repeats, homo-amino acid repeats, or sequences of the FVIII B-domain.

As a further alternative, the C-terminus of Factor VIII is connected to the N-terminus of the VWF D'D3 domains or fragments thereof. This will aid in the expression and intracellular formation of covalent bonds with coexpressed half-life extended VWF. More preferably, the VWF comprises amino acids 764 to 1241, 764 to 1242, 764 to 1247 or 764 to 1270 or any sequence between 764 and 1241 to 1270, respectively, of SEQ ID NO: 2 or a variant or a fragment thereof.

Preferably, the D'D3 domains of VWF (or the D1D2D'D3 domains) are attached to the N-terminus of Factor VIII by a cleavable linker; inclusion of a signal peptide N-terminal to the VWF domains would lead to secretion upon expression of the protein in mammalian cells. More preferably, the cleavable linker comprises a thrombin cleavage site, preferably one of the thrombin cleavage sites of FVIII which comprise of sequences encompassing the thrombin cleavage sites at amino acid positions 372, 740 and/or 1689 of SEQ ID NO. 6, respectively.

Optionally, the linker comprises additional residues between the D'D3 domains of VWF and the Factor VIII molecule, the additional residues comprising a peptide of sufficient length to permit the interaction of Factor VIII and VWF via the a3 and D'D3 regions, respectively. Preferably, more than 20, 30, 40, 50, 70, 100, 120 or 150 additional amino acids are added. Preferably the additional amino acids comprise a flexible, non-structural peptide, more preferably they comprise or even consist of glycine-serine repeats, proline-alanine-serine repeats, homo-amino acid repeats, or sequences of the FVIII B-domain.

Examples of such fusion proteins with various linkers are shown in SEQ ID NOs: 144-177; each sequence shown, i.e. the DNA and its translation product (the fusion protein), as well as DNA sequences encoding the same translation product by virtue of the redundancy of the genetic code (e.g. codon-optimized versions of those DNA sequences) are specific embodiments of the invention. However, the skilled person will be able to design many more examples of such fusion proteins that also fall within the present invention.

Preferably the VWF portion of the complex of the invention forms multimers as it does in nature. For particular reasons it may be desirable for the VWF portion of the complex to form not more than a dimer. This can be achieved by deleting the propeptide sequence of the VWF and fusing the VWF signal peptide directly to the N-terminus of D', thereby allowing for the expression of a propeptide depleted VWF molecule. Due to the absence of the propeptide the multimerization via the D'D3 domain will be blocked. For other particular reasons it may be desirable for the VWF portion of the complex to form not more than a monomer. This can be achieved by deleting the propeptide sequence of the VWF and fusing the VWF signal peptide directly to D' allowing for the expression of a propeptide depleted VWF molecule and in addition by introducing a mutation of Cys2773 into another suitable amino acid, e.g. alanine.

Figure 12A:
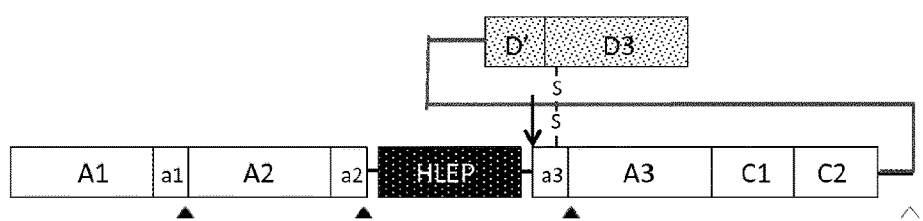
Figure 12B:
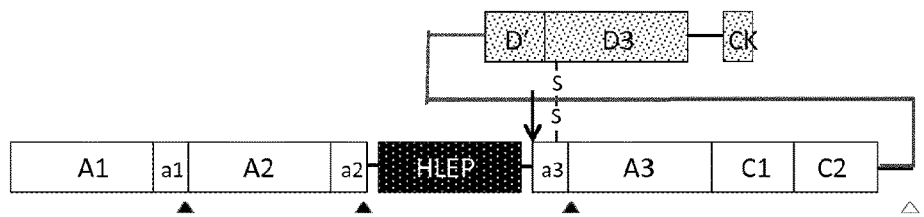
Figure 12C:
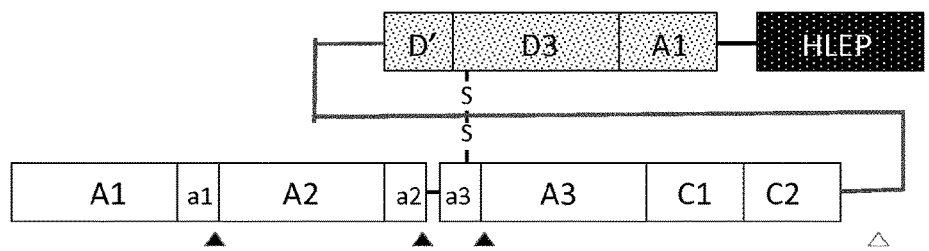
Figure 12D:
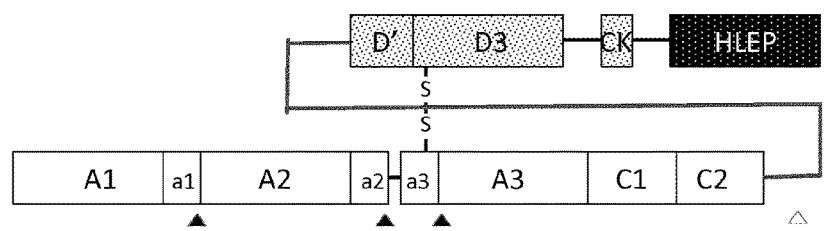
Figure 12E:
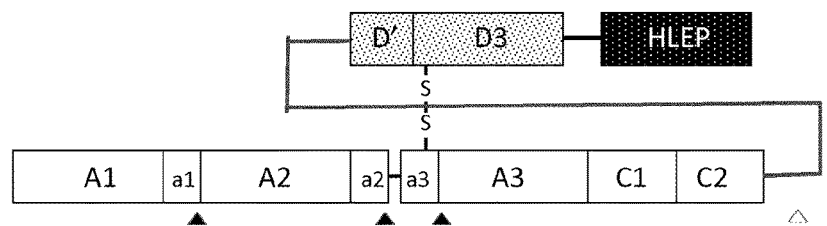
Figure 12F:
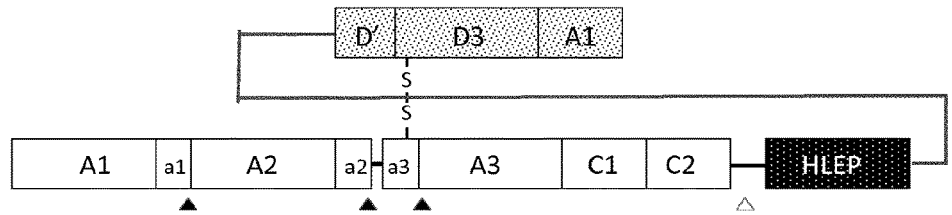
Figure 12G:
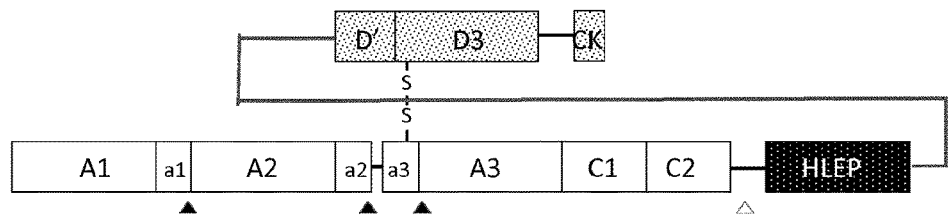
Figure 12H:
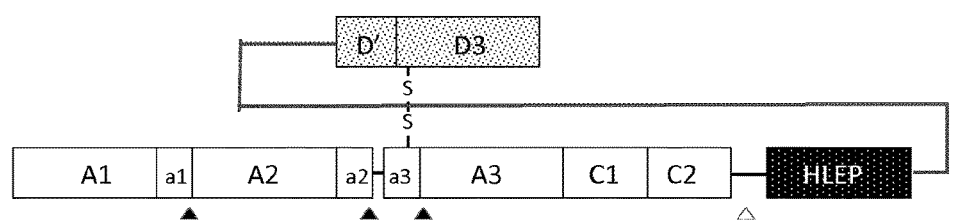
Figure 12I:
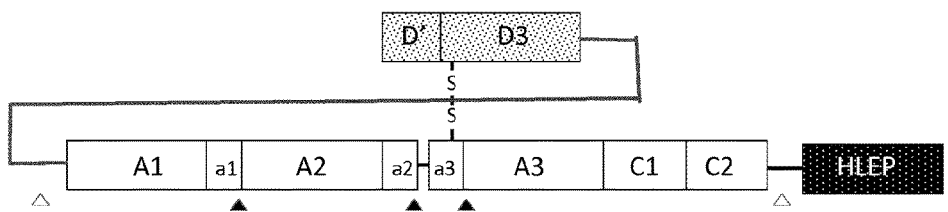
Figure 12J:
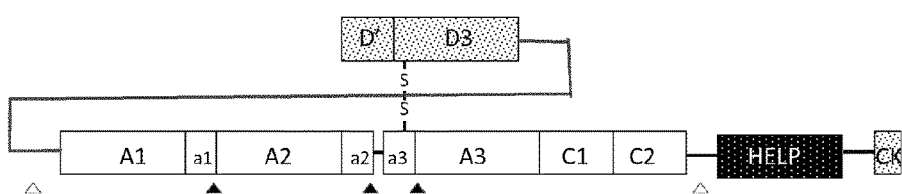
Figure 12K:
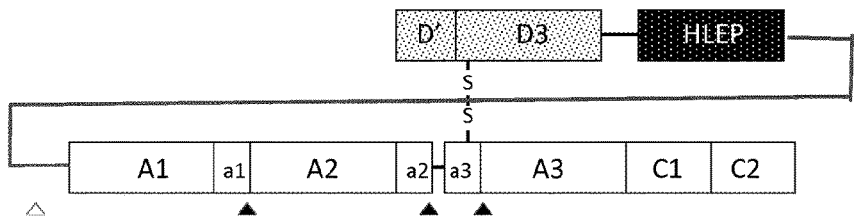
Figure 12L:
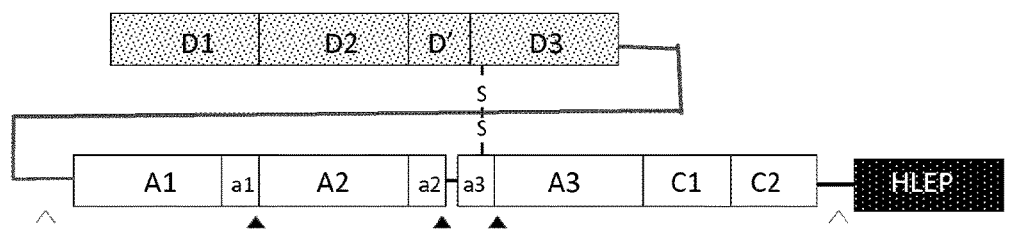
Figure 12M:
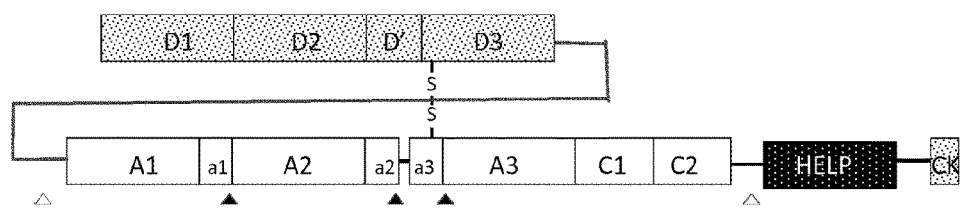
Figure 12N:
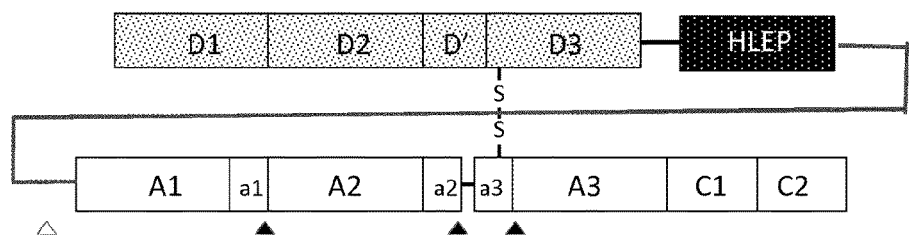

Another embodiment of the invention is the combination of any of the embodiments described above to form a Factor VIII/VWF complex where one or more covalent bond(s) exist(s) directly between the Factor VIII and VWF binding sites (preferably a disulphide bond), and where another covalent bond exists between the Factor VIII and the VWF part of the molecule and where one or more HLEPs is connected to Factor VIII, to VWF, or to both (FIGS. 12A-12N). Such Factor VIII/VWF complexes may be advantageous because they may be producible with higher yields than complexes with only a disulphide bond between the Factor VIII and the VWF moiety.

A second aspect of the invention is a method of producing the covalent complexes of Factor VIII and VWF described above, comprising co-expressing the Factor VIII and VWF in a eukaryotic cell line. Therefore, the invention also relates to polynucleotides encoding the proteins forming the complex of the invention.

The term "polynucleotide(s)" generally refers to any polyribonucleotide or polydeoxyribonucleotide that may be unmodified RNA or DNA or modified RNA or DNA. The polynucleotide may be single- or double-stranded DNA, single or double-stranded RNA. As used herein, the term "polynucleotide(s)" also includes DNAs or RNAs that comprise one or more modified bases and/or unusual bases, such as inosine. It will be appreciated that a variety of modifications may be made to DNA and RNA that serve many useful purposes known to those of skill in the art. The term "polynucleotide(s)" as it is employed herein embraces such chemically, enzymatically or metabolically modified forms of polynucleotides, as well as the chemical forms of DNA and RNA characteristic of viruses and cells, including, for example, simple and complex cells.

The skilled person will understand that, due to the degeneracy of the genetic code, a given polypeptide can be encoded by different polynucleotides. These "variants" are encompassed by this invention.

Preferably, the polynucleotide of the invention is an isolated polynucleotide. The term "isolated" polynucleotide refers to a polynucleotide that is substantially free from other nucleic acid sequences, such as and not limited to other chromosomal and extrachromosomal DNA and RNA. Isolated polynucleotides may be purified from a host cell. Conventional nucleic acid purification methods known to the skilled person may be used to obtain isolated polynucleotides. The term also includes recombinant polynucleotides and chemically synthesized polynucleotides.

The invention further relates to a group of polynucleotides which together encode the modified VWF and/or the modified Factor VIII of the invention, or the polypeptide of the invention comprising the modified VWF and/or the modified Factor VIII. For example, a first polynucleotide in the group may encode the heavy chain of a modified Factor VIII, and a second polynucleotide may encode the light chain of a modified Factor VIII, and a third polynucleotide may encode the modified VWF.

Yet another aspect of the invention is a plasmid or vector comprising a polynucleotide according to the invention. Preferably, the plasmid or vector is an expression vector. In a particular embodiment, the vector is a transfer vector for use in human gene therapy.

The invention also relates to a group of plasmids or vectors that comprise the above group of polynucleotides. A first plasmid or vector may contain said first polynucleotide, and a second plasmid or vector may contain said second polynucleotide. Alternatively, two or more coding sequences are cloned into one expression vector either using separate promoter sequences or one promoter and an internal ribosome entry site (IRES) element to direct the expression of more than one protein that is part of the complex of the invention.

Still another aspect of the invention is a host cell comprising a polynucleotide, a plasmid or vector of the invention, or a group of polynucleotides or a group of plasmids or vectors as described herein.

The host cells of the invention may be employed in a method of producing the covalent complex of the invention. The method comprises:
  (a) culturing host cells of the invention under conditions such that the desired protein complex is expressed; and
  (b) optionally recovering the desired protein complex from the host cells or from the culture medium.

The production of recombinant mutant proteins at high levels in suitable host cells requires the assembly of the above-mentioned modified cDNAs into efficient transcriptional units together with suitable regulatory elements in a recombinant expression vector that can be propagated in various expression systems according to methods known to those skilled in the art. Efficient transcriptional regulatory elements could be derived from viruses having animal cells as their natural hosts or from the chromosomal DNA of animal cells. Preferably, promoter-enhancer combinations derived from the Simian Virus 40, adenovirus, BK polyoma virus, human cytomegalovirus, or the long terminal repeat of Rous sarcoma virus, or promoter-enhancer combinations including strongly constitutively transcribed genes in animal cells like beta-actin or GRP78 can be used. In order to achieve stable high levels of mRNA transcribed from the cDNAs, the transcriptional unit should contain in its 3'-proximal part a DNA region encoding a transcriptional termination-polyadenylation sequence. Preferably, this sequence is derived from the Simian Virus 40 early transcriptional region, the rabbit beta-globin gene, or the human tissue plasminogen activator gene.

The cDNAs may then be integrated into the genome of a suitable host cell line for expression of the modified Factor VIII and/or VWF proteins, which then assemble into the covalent complex of the invention. Alternatively, stable episomal vectors can also be used that remain in the cell as stable extrachromosomal elements. Preferably this cell line should be an animal cell-line of vertebrate origin in order to ensure correct folding, disulfide bond formation, asparagine-linked glycosylation and other post-translational modifications as well as secretion into the cultivation medium. Examples of other post-translational modifications are tyrosine O-sulfation and proteolytic processing of the nascent polypeptide chain. Examples of cell lines that can be used are monkey COS-cells, mouse L-cells, mouse C127-cells, hamster BHK-21 cells, human HEK-293 cells, and hamster CHO-cells.

The recombinant expression vector encoding the corresponding cDNAs can be introduced into an animal or human cell line in several different ways. For instance, recombinant expression vectors can be created from vectors based on different animal viruses. Examples of these are vectors based on baculovirus, vaccinia virus, adenovirus, and preferably bovine papilloma virus.

The transcription units encoding the corresponding DNAs can also be introduced into animal cells together with another recombinant gene which may function as a dominant selectable marker in these cells in order to facilitate the isolation of specific cell clones which have integrated the recombinant DNA into their genome. Examples of this type of dominant selectable marker genes are Tn5 amino glycoside phosphotransferase, conferring resistance to geneticin (G418), hygromycin phosphotransferase, conferring resistance to hygromycin, and puromycin acetyl transferase, conferring resistance to puromycin. The recombinant expression vector encoding such a selectable marker can reside either on the same vector as the one encoding the cDNA of the desired protein, or it can be encoded on a separate vector which is simultaneously introduced and integrated to the genome of the host cell, frequently resulting in a tight physical linkage between the different transcription units.

Other types of selectable marker genes which can be used together with the cDNA of the desired proteins are based on various transcription units encoding dihydrofolate reductase (dhfr). After introduction of this type of gene into cells lacking endogenous dhfr-activity, preferentially CHO-cells (DUKX-B11, DG-44), it will enable these to grow in media lacking nucleosides. An example of such a medium is Ham's F12 without hypoxanthine, thymidin, and glycine. These dhfr-genes can be introduced together with the cDNA transcriptional units into CHO-cells of the above type, either linked on the same vector or on different vectors, thus creating dhfr-positive cell lines producing recombinant protein.

If the above cell lines are grown in the presence of the cytotoxic dhfr-inhibitor methotrexate, new cell lines resistant to methotrexate will emerge. These cell lines may produce recombinant protein at an increased rate due to the amplified number of linked dhfr and the desired protein's transcriptional units. When propagating these cell lines in increasing concentrations of methotrexate (1-10000 nM), new cell lines can be obtained which produce the desired protein at very high rate.

The above cell lines producing the desired protein can be grown on a large scale, either in suspension culture or on various solid supports. Examples of these supports are micro carriers based on dextran or collagen matrices, or solid supports in the form of hollow fibres or various ceramic materials. When grown in cell suspension culture or on micro carriers the culture of the above cell lines can be performed either as a batch culture or as a perfusion culture with continuous production of conditioned medium over extended periods of time. Thus, according to the present invention, the above cell lines are well suited for the development of an industrial process for the production of the desired recombinant mutant proteins It is preferred to purify the complex of the invention to ≥80% purity, more preferably 95% purity, and particularly preferred is a pharmaceutically pure state that is greater than 99.9% pure with respect to contaminating macromolecules from the cell culture, particularly other proteins and nucleic acids, and free of infectious and pyrogenic agents. Preferably, an isolated or purified modified covalent complex of the invention is substantially free of other, non-related polypeptides.

The covalent complex of the invention, which accumulates in the medium of secreting cells of the above types, can be concentrated and purified by a variety of biochemical and chromatographic methods, including methods utilizing differences in size, charge, hydrophobicity, solubility, specific affinity, etc. between the desired protein and other substances in the cell cultivation medium.

An example of such purification is the adsorption of the recombinant mutant protein to a monoclonal antibody, directed to e.g. a HLEP, preferably human albumin, or directed to the respective coagulation factor, which is immobilised on a solid support. After adsorption of the complex to the support, washing and desorption, the protein can be further purified by a variety of chromatographic techniques based on the above properties. The order of the purification steps is chosen e.g. according to capacity and selectivity of the steps, stability of the support or other aspects. Preferred purification steps e.g. are but are not limited to ion exchange chromatography steps, immunoaffinity chromatography steps, affinity chromatography steps, hydrophobic interaction chromatography steps, dye chromatography steps, hydroxyapatite chromatography steps, multimodal chromatography steps, and size exclusion chromatography steps.

In order to minimize the theoretical risk of virus contaminations, additional steps may be included in the process that allow effective inactivation and/or elimination of viruses. Such steps e.g. are heat treatment in the liquid or solid state, treatment with solvents and/or detergents, radiation in the visible or UV spectrum, gamma-irradiation or nanofiltration.

The modified polynucleotides (e.g. DNA) of this invention may also be integrated into a transfer vector for use in the human gene therapy.

In another embodiment of this aspect of the invention, the (modified) Factor VIII and the (modified) VWF are covalently connected by chemical cross-linking.

The various products of the invention are useful as medicaments. Accordingly, a third aspect of the invention is a covalent complex as described above for use in medicine, preferably for use in the treatment or prophylaxis of a bleeding disorder. Preferably, the bleeding disorder is hemophilia A or VWD.

A fourth aspect of the invention is a pharmaceutical composition comprising the covalent complex described above. The covalent complex as described in this invention can be formulated into pharmaceutical preparations for therapeutic use. The purified protein may be dissolved in conventional physiologically compatible aqueous buffer solutions to which there may be added, optionally, pharmaceutical excipients to provide pharmaceutical preparations.

Such pharmaceutical carriers and excipients as well as suitable pharmaceutical formulations are well known in the art (see for example "Pharmaceutical Formulation Development of Peptides and Proteins", Frokjaer et al., Taylor & Francis (2000) or "Handbook of Pharmaceutical Excipients", $3^{rd}$ edition, Kibbe et al., Pharmaceutical Press (2000)). Standard pharmaceutical formulation techniques are well known to persons skilled in the art (see, e.g., 2005 Physicians' Desk Reference®, Thomson Healthcare: Montvale, N. J., 2004; Remington: The Science and Practice of Pharmacy, 20th ed., Gennaro et al., Eds. Lippincott Williams & Wilkins: Philadelphia, Pa., 2000). In particular, the pharmaceutical composition comprising the covalent complex of the invention may be formulated in lyophilized or stable liquid form. The polypeptide variant may be lyophilized by a variety of procedures known in the art. Lyophilized formulations are reconstituted prior to use by the addition of one or more pharmaceutically acceptable diluents such as sterile water for injection or sterile physiological saline solution.

Formulations of the composition are delivered to the individual by any pharmaceutically suitable means of administration. Various delivery systems are known and can be used to administer the composition by any convenient route. Preferentially, the compositions of the invention are administered systemically. For systemic use, the complex of the invention is formulated for parenteral (e.g. intravenous, subcutaneous, intramuscular, intraperitoneal, intracerebral, intrapulmonar, intranasal or transdermal) or enteral (e.g., oral, vaginal or rectal) delivery according to conventional methods. The most preferential routes of administration are intravenous and subcutaneous administration. The formulations can be administered continuously by infusion or by bolus injection. Some formulations encompass slow release systems.

The covalent complex of the present invention is administered to patients in a therapeutically effective dose, meaning a dose that is sufficient to produce the desired effects, preventing or lessening the severity or spread of the condition or indication being treated without reaching a dose which produces intolerable adverse side effects. The exact dose depends on many factors as e.g. the indication, formulation, mode of administration and has to be determined in preclinical and clinical trials for each respective indication.

The pharmaceutical composition of the invention may be administered alone or in conjunction with other therapeutic agents. These agents may be incorporated as part of the same pharmaceutical preparation.

A further aspect of the invention is a method of treating or preventing a bleeding disorder by administering an effective amount of a complex described above to a subject in need thereof. In another embodiment, the method comprises administering to the individual an efficient amount of a polynucleotide of the invention or of a plasmid or vector of the invention. Alternatively, the method may comprise administering to the individual an efficient amount of the host cells of the invention described herein.

The present invention will be further described in the following, non-limiting examples. This description of specific embodiments of the invention will be made in conjunction with the appended figures.

FIGS. 1A-1C: FIG. 1A, domain structure of mature FVIII protein; FIG. 1B domain structure of a B-domain deleted mature FVIII protein; FIG. 1C, domain structure of a B-domain deleted single-chain mature FVIII protein. The arrows show the PACE/Furin cleavage sites, the triangles the thrombin cleavage sites for activation.

FIGS. 2A and 2B: Domain structure of pro-VWF (FIG. 2A) and mature VWF (FIG. 2B) according to Zhou et al., 2012. VWF-dimerization and multimerization are not shown.

FIG. 3: Example of a covalent complex where Factor VIII and VWF are linked via a disulphide bridge. VWF domains are shown in grey, Factor VIII in white.

FIGS. 4A-4J: Examples of modified FVIII with VWF domains including the VWF CK domain. FVIII domains are shown in white, VWF domains are shown in grey. Black triangles show thrombin cleavage sites, open triangles show protease cleavage sites introduced into the linker.

FIGS. 5A-5E: Examples of modified FVIII with VWF domains including D'D3 domains. Arrows show PACE/Furin cleavage sites, black triangles show thrombin cleavage sites, open triangles show protease cleavage sites introduced into the linker.

FIGS. 6A-6C: FVIII modified by additional VWF domains. Symbols as explained above.

FIG. 7: Example of a covalent complex linked by chemical crosslinking.

Figure 8A:
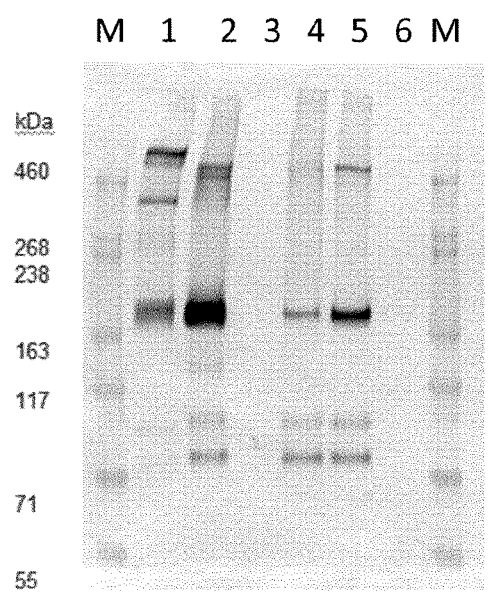
Figure 8B:
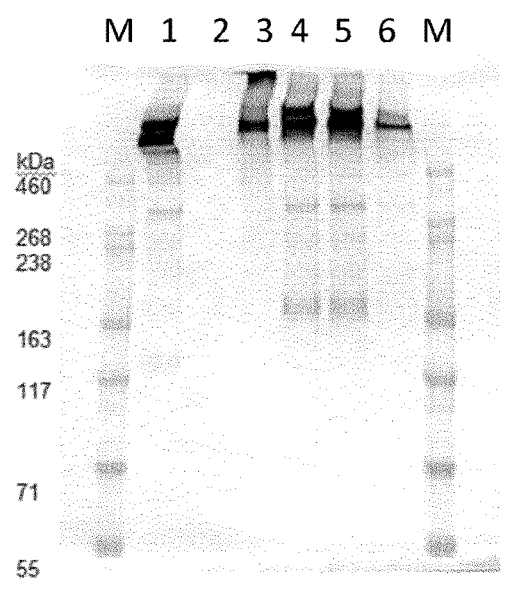

FIGS. 8A and 8B: Western Blot of covalently linked FVIII-SC/VWF-FP molecules. M, molecular size marker. FIG. 8A, anti-FVIII, FIG. 8B, anti-VWF antibody blot.

Figure 9:
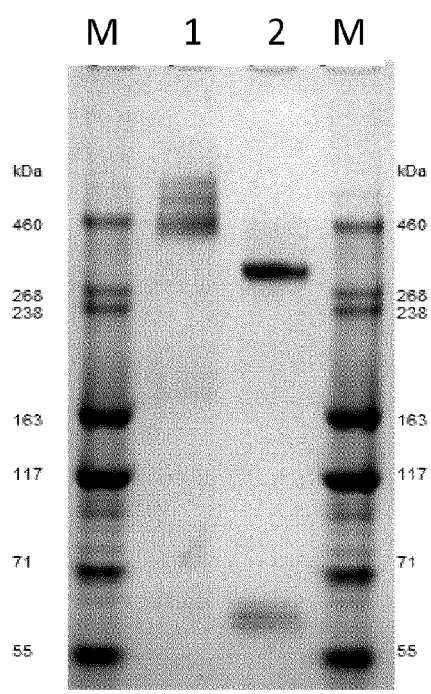

FIG. 9: Separation of covalently linked FVIII-SC/VWF-FP molecules on a reducing SDS-PAGE after purification (lane 1) and subsequent thrombin cleavage (lane 2).

FIGS. 10A and 10B: Multimer gel analysis of a covalently linked FVIII-SC/VWF-FP multimer molecule by anti-VWF (FIG. 10A) and anti-FVIII (FIG. 10B) antibodies. Lane 1, plasma.derived VWF; lane 2 and 3, supernatant of two clones expressing covalently linked FVIII-SC/VWF-FP multimers; lane 4, rVWF-FP.

Figure 11A:
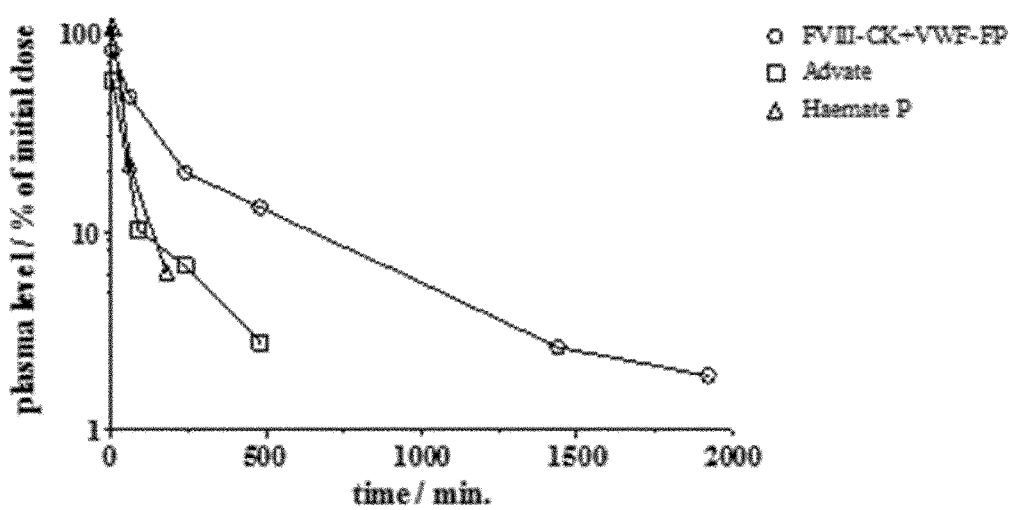
Figure 11B:
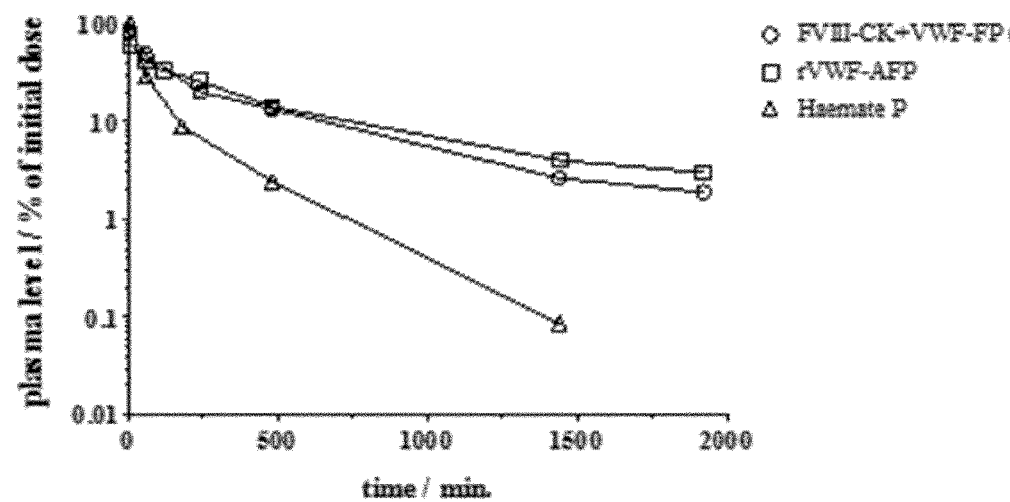

FIGS. 11A and 11B: Pharmacokinetic analysis of a covalently linked FVIII-SC/VWF-FP multimer (circles) in rats. FIG. 11A, FVIII data, FIG. 11B, VWF data.

FIGS. 12A-12N: Examples of constructs with both disulphide bridge and fusion of VWF to Factor VIII, optionally via a peptide linker.

SEQUENCE LISTING

SEQ ID NO: 1: cDNA sequence of human VWF
SEQ ID NO: 2: Protein sequence of human VWF
SEQ ID NO: 3: PCR primer VWF+
SEQ ID NO: 4: PCR primer VWF−
SEQ ID NO: 5: cDNA sequence of human FVIII
SEQ ID NO: 6: Protein sequence of mature human FVIII
SEQ ID NO: 7: Protein sequence of mature human serum albumin
SEQ ID NOs: 8-143: Various primers and oligonucleotides for mutagenesis as listed in the examples.
SEQ ID NOs: 144-177: Fusion protein sequences (DNA and protein) of human single chain FVIII with various VWF-CK comprising sequences, connected through various linkers.

EXAMPLES

Example 1

Generation of VWF Mutants with Cysteine Residues in the D'D3 Region

An expression plasmid (pIRESpuro3; BD Biosciences, Franklin Lakes, N.J., USA) containing a full length VWF cDNA sequence in its multiple cloning site had been generated previously (pVWF-2448). The VWF cDNA sequence contained in this vector is displayed as SEQ ID No. 1, its corresponding protein sequence as SEQ ID No. 2.

For generating such expression vectors, the VWF cDNA may be amplified by polymerase chain reaction (PCR) using primer set VWF+ and VWF− (SEQ ID NOs. 3 and 4) under standard conditions known to those skilled in the art (and as described e.g. in Current Protocols in Molecular Biology, Ausubel F M et al. (eds.) John Wiley & Sons, Inc.; http://www.currentprotocols.com/WileyCDA/) from a plasmid containing VWF cDNA (as obtainable commercially, e.g. pMT2-VWF from ATCC, No. 67122). The resulting PCR fragment may be digested by restriction endonuclease EcoRI and ligated into expression vector pIRESpuro3 which had been linearized by EcoRI. The resulting expression plasmid, screened for correct orientation of the insert, will contain a wild-type cDNA of VWF downstream of the CMV promoter suitable for VWF expression.

In order to introduce mutations into the VWF sequence site directed mutagenesis (QuickChange XL Site Directed Mutagenesis Kit, Agilent Technologies, La Jolla, Calif., USA) was applied on plasmid pVWF-2448 according to the following protocol as suggested by the kit manufacturer. Per mutagenesis reaction 5 µl of 10× reaction buffer, 1 µl of plasmid DNA pVWF-2448 (50 ng), 1 µl (10 pmol/µl) each of the respective two mutagenesis oligonucleotides, 1 µl dNTP Mix, 3 µl Quick-Solution, 1 µl Turbo Polymerase (2.5 U/µl) and 37 µl H$_2$O were mixed and subjected to a polymerase chain reaction with an initial denaturation for 2 min at 95° C., 18 cycles of a) denaturation for 50 sec. at 95° C., b) annealing for 50 sec at 60° C. and c) elongation for 14 min at 68° C., followed by a single terminal elongation phase of 7 min at 68° C. Subsequently 1 µl of DpnI enzyme from the kit was added and the reaction incubated for another 60 min at 37° C. After that 3 µl of the mutagenesis reaction were transformed into E. coli competent cells (e.g. XL10 Gold, Agilent Technologies). Clones were isolated, plasmid DNA extracted and the mutations in the VWF sequences were verified by DNA sequencing.

The following table lists oligonucleotides used for mutagenesis of the VWF cDNA sequence and the respective mutations introduced.

| VWF mutation | Designation | Mutagenesis oligonucleotide sequence (5'→3') | SEQ ID NO |
|---|---|---|---|
| R768C | We4674 | GTGTTCCCTGAGCTGCTGCCCTCCTATGGTCAAACTGG | 89 |
|  | We4675 | CCAGTTTGACCATAGGAGGGCAGCAGCTCAGGGAACAC | 90 |
| R782C | We4218 | CCCGCTGACAACCTGTGCGCTGAAGGGCTCGAGTG | 8 |
|  | We4219 | CACTCGAGCCCTTCAGCGCACAGGTTGTCAGCGGG | 9 |
| G785C | We4226 | CAACCTGCGGGCTGAATGCCTCGAGTGTACCAAAACG | 10 |
|  | We4227 | CGTTTTGGTACACTCGAGGCATTCAGCCCGCAGGTTG | 11 |
| E787C | We4236 | GGGCTGAAGGGCTCTGCTGTACCAAAACGTGCCAG | 12 |
|  | We4237 | CTGGCACGTTTTGGTACAGCAGAGCCCTTCAGCCC | 13 |
| A789C | We4238 | GGGCTCGAGTGTTGCAAAACGTGCCAGAACTATGAC | 14 |
|  | We4239 | GTCATAGTTCTGGCACGTTTTGCAACACTCGAGCCC | 15 |
| T789C | We4238 | GGGCTCGAGTGTTGCAAAACGTGCCAGAACTATGAC | 14 |
|  | We4239 | GTCATAGTTCTGGCACGTTTTGCAACACTCGAGCCC | 15 |
| T791C | We4240 | GGGCTCGAGTGTACCAAATGCTGCCAGAACTATGACCTG | 16 |
|  | We4241 | CAGGTCATAGTTCTGGCAGCATTTGGTACACTCGAGCCC | 17 |
| Q793C | We4242 | GAGTGTACCAAAACGTGCTGCAACTATGACCTGGAGTGC | 18 |
|  | We4243 | GCACTCCAGGTCATAGTTGCAGCACGTTTTGGTACACTC | 19 |
| N794C | We4244 | GTACCAAAACGTGCCAGTGCTATGACCTGGAGTGCATGAGC | 20 |
|  | We4245 | GCTCATGCACTCCAGGTCATAGCACTGGCACGTTTTGGTAC | 21 |
| Y795C | We4246 | GTACCAAAACGTGCCAGAACTGTGACCTGGAGTGCATGAGC | 22 |
|  | We4247 | GCTCATGCACTCCAGGTCACAGTTCTGGCACGTTTTGGTAC | 23 |
| M800C | We4228 | CTATGACCTGGAGTGCTGCAGCATGGGCTGTGTCTC | 24 |
|  | We4229 | GAGACACAGCCCATGCTGCAGCACTCCAGGTCATAG | 25 |
| R816C | We4220 | CCCCGGGCATGGTCTGCCATGAGAACAGATGTGTG | 26 |
|  | We4221 | CACACATCTGTTCTCATGGCAGACCATGCCCGGGG | 27 |
| H817C | We4248 | GGGCATGGTCCGGTGTGAGAACAGATGTGTGGCC | 28 |
|  | We4249 | GGCCACACATCTGTTCTCACACCGGACCATGCCC | 29 |
| P828C | We4250 | TGGCCCTGGAAAGGTGTTGCTGCTTCCATCAGGGC | 30 |
|  | We4251 | GCCCTGATGGAAGCAGCAACACCTTTCCAGGGCCA | 31 |
| F830C | We4252 | GAAAGGTGTCCCTGCTGCCATCAGGGCAAGGAG | 32 |
|  | We4253 | CTCCTTGCCCTGATGGCAGCAGGGACACCTTTC | 33 |
| E835C | We4254 | CTTCCATCAGGGCAAGTGCTATGCCCCTGGAGAAAC | 34 |
|  | We4255 | GTTTCTCCAGGGGCATAGCACTTGCCCTGATGGAAG | 35 |
| P838C | We4256 | GGGCAAGGAGTATGCCTGTGGAGAAACAGTGAAGATT | 36 |
|  | We4257 | AATCTTCACTGTTTCTCCACAGGCATACTCCTTGCCC | 37 |
| D853C | We4258 | CACTTGTGTCTGTCGGTGCCGGAAGTGGAACTGCAC | 38 |
|  | We4259 | GTGCAGTTCCACTTCCGGCACCGACAGACACAAGTG | 39 |
| R854C | We4222 | CTTGTGTCTGTCGGGACTGCAAGTGGAACTGCACAG | 40 |
|  | We4223 | CTGTGCAGTTCCACTTGCAGTCCCGACAGACACAAG | 41 |
| K855C | We4260 | CTGTCGGGACCGGTGCTGGAACTGCACAGACCATG | 42 |
|  | We4261 | CATGGTCTGTGCAGTTCCAGCACCGGTCCCGACAG | 43 |
| W856C | We4262 | CTGTCGGGACCGGAAGTGCAACTGCACAGACCATG | 44 |
|  | We4263 | CATGGTCTGTGCAGTTGCACTTCCGGTCCCGACAG | 45 |
| D879C | We4230 | CCACTACCTCACCTTCTGCGGGCTCAAATACCTGTTCC | 46 |
|  | We4231 | GGAACAGGTATTTGAGCCCGCAGAAGGTGAGGTAGTGG | 47 |
| R924C | We4224 | CCTCAGTGAAATGCAAGAAATGCGTCACCATCCTGGTGG | 48 |
|  | We4225 | CCACCAGGATGGTGACGCATTTCTTGCATTTCACTGAGG | 49 |
| E933C | We4435 | GTCGAGGGCGGCTGCATCGAACTGTTCGACGGC | 143 |
|  | We4436 | GCCGTCGAACAGTTCGATGCAGCCGCCCTCGAC | 91 |
| T951C | We4447 | GGCCTATGAAGGACGAATGCCATTTCGAGGTGGTCGAG | 92 |
|  | We4448 | CTCGACCACCTCGAAATGGCATTCGTCCTTCATAGGCC | 93 |
| L984C | We4469 | CCTGTCCATTAGTGTGGTGTGCAAACAGACCTATCAGGAAAAAGTCTG | 94 |
|  | We4470 | CAGACTTTTTCCTGATAGGTCTGTTTGCACACCACACTAATGGACAGG | 95 |

-continued

| VWF mutation | Designation | Mutagenesis oligonucleotide sequence (5'→3') | SEQ ID NO |
|---|---|---|---|
| E1015C | We4485 | CTAGCAACCTGCAGGTCTGCGAGGACCCCGTGG | 96 |
|  | We4486 | CCACGGGGTCCTCGCAGACCTGCAGGTTGCTAG | 97 |
| Q1053C | We4232 | CTGCCATAACAACATCATGAAGTGCACGATGGTGGATTCCTCCTG | 50 |
|  | We4233 | CAGGAGGAATCCACCATCGTGCACTTCATGATGTTGTTATGGCAG | 51 |
| D1076 | We4600 | GGATTGCAACAAACTGGTCTGCCCTGAACCTTACCTGGACG | 98 |
|  | We4601 | CGTCCAGGTAAGGTTCAGGGCAGACCAGTTTGTTGCAATCC | 99 |
| E1078C | We4234 | CAACAAGCTGGTGGACCCCTGCCCATATCTGGATGTCTGC | 52 |
|  | We4235 | GCAGACATCCAGATATGGGCAGGGGTCCACCAGCTTGTTG | 53 |
| P1079C | We4604 | CAACAAACTGGTCGATCCTGAATGCTACCTGGACGTGTGTATCTAC | 100 |
|  | We4605 | GTAGATACACACGTCCAGGTAGCATTCAGGATCGACCAGTTTGTTG | 101 |
| K1116C | We4519 | GCGCTCAGCACGGATGCGTCGTGACATGGCGC | 102 |
|  | We4520 | GCGCCATGTCACGACGCATCCGTGCTGAGCGC | 103 |
| N1134C | We4525 | CCTGCGAGGAACGGTGCCTGCGCGAGAATGGC | 104 |
|  | We4526 | GCCATTCTCGCGCAGGCACCGTTCCTCGCAGG | 105 |
| E1161C | We4531 | CACATGCCAGCATCCCTGCCCCCTGGCTTGTCC | 106 |
|  | We4532 | GGACAAGCCAGGGGGCAGGGATGCTGGCATGTG | 107 |
| R1204C | We4539 | CGAAGTGGCCGGCTGCAGATTCGCCTCCGGC | 108 |
|  | We4540 | GCCGGAGGCGAATCTGCAGCCGGCCACTTCG | 109 |

Using the protocols and plasmids described above and by applying molecular biology techniques known to those skilled in the art (and as described e.g. in Current Protocols in Molecular Biology, ibid) other constructs can be made by the artisan for mutation of any amino acid residue within SEQ ID No. 2.

As the half-life extending principle in these examples albumin fusion to VWF has been chosen. This is indicated by the suffix -FP.

To generate albumin fusions of VWF and VWF mutants, insertion of linker and albumin cDNA sequences was performed in analogy to the examples described in WO 2009/156137.

For generation of an expression cassette containing a VWF mutant which does not contain the propeptide sequence a mutagenesis as described above is performed using primers with SEQ ID 54 and 55.

This will result in a VWF sequence wherein the signal peptide (amino acids 1 to 22 of SEQ ID no. 2) is fused directly to the D' region (amino acid 764 of SEQ ID no. 2).

The following table lists residues that were interchanged with cysteine in VWF D'D3 domain in a scattered approach:

| Cystein residues in human von Willebrand Factor | |
|---|---|
| S | 764 |
| R | 768 |
| P | 770 |
| K | 773 |
| N | 780 |
| R | 782 |
| G | 785 |
| E | 787 |
| T | 789 |
| T | 791 |
| Q | 793 |
| N | 794 |
| Y | 795 |
| M | 800 |
| S | 801 |
| M | 802 |

-continued

| Cystein residues in human von Willebrand Factor | |
|---|---|
| G | 813 |
| R | 816 |
| H | 817 |
| E | 818 |
| L | 824 |
| P | 828 |
| F | 830 |
| Q | 832 |
| E | 835 |
| P | 838 |
| T | 841 |
| K | 843 |
| D | 853 |
| R | 854 |
| K | 855 |
| W | 856 |
| I | 870 |
| A | 873 |
| L | 876 |
| D | 879 |
| K | 882 |
| F | 885 |
| V | 892 |
| Q | 895 |
| P | 902 |
| F | 905 |
| L | 908 |
| N | 911 |
| S | 918 |
| R | 924 |
| I | 927 |
| E | 930 |
| E | 933 |
| L | 936 |
| G | 939 |
| N | 942 |
| R | 945 |
| K | 948 |
| T | 951 |
| E | 954 |
| E | 957 |
| R | 960 |
| I | 963 |

| Cystein residues in human von Willebrand Factor | |
|---|---|
| L | 966 |
| A | 969 |
| V | 972 |
| D | 975 |
| L | 978 |
| S | 981 |
| L | 984 |
| T | 987 |
| E | 990 |
| D | 1000 |
| Q | 1003 |
| D | 1006 |
| S | 1009 |
| L | 1012 |
| E | 1015 |
| P | 1018 |
| F | 1021 |
| S | 1024 |
| V | 1027 |
| R | 1035 |
| L | 1039 |
| A | 1042 |
| I | 1050 |
| Q | 1053 |
| V | 1056 |
| T | 1064 |
| D | 1067 |
| V | 1075 |
| D | 1076 |
| P | 1077 |
| E | 1078 |
| P | 1079 |
| Y | 1080 |
| L | 1081 |
| I | 1094 |
| A | 1105 |
| A | 1108 |
| K | 1116 |
| W | 1120 |
| A | 1123 |
| N | 1134 |
| N | 1138 |
| R | 1145 |
| E | 1161 |
| K | 1181 |
| E | 1185 |
| P | 1193 |
| R | 1204 |
| S | 1208 |
| T | 1213 |
| S | 1217 |
| V | 1230 |
| G | 1241 |

Example 2

Generation of FVIII Mutants with Cysteine Residues in the a3 Domain

Any FVIII cDNA sequence cloned in an expression plasmid can be used to introduce Cys mutations into the a3 domain. Preferably a single-chain FVIII construct with partial B domain depletion is used (see examples in WO 2004/067566).

For generating FVIII expression vectors, the FVIII cDNA may be amplified by polymerase chain reaction (PCR) using primer set of SEQ ID NO 56 and 57 under standard conditions known to those skilled in the art (and as described e.g. in Current Protocols in Molecular Biology, Ausubel F M et al. (eds.) John Wiley & Sons, Inc.; http://www.current-protocols.com/WileyCDA/) from a plasmid containing FVIII cDNA.

The resulting PCR fragment is digested by restriction endonucleases NheI and NotI and ligated into expression vector pIRESpuro3 (BD Biosciences, Franklin Lakes, N.J., USA) which had been linearized by NheI and NotI. The resulting expression plasmid will contain a cDNA of FVIII downstream of the CMV promoter and is suitable for FVIII expression in animal cell culture.

In order to introduce mutations into the FVIII sequence site directed mutagenesis (QuickChange XL Site Directed Mutagenesis Kit, Agilent Technologies, La Jolla, Calif., USA) is applied on the FVIII expression plasmid as suggested by the kit manufacturer.

The following table lists the oligonucleotides used for mutagenesis of the FVIII cDNA sequence and the respective mutations introduced.

| FVIII mutation | Designation | Mutagenesis oligonucleotide sequence (5'→3') | SEQ ID NO |
|---|---|---|---|
| T1654C | We4630 | GCCACCACAATTCCAGAAAATACTTGCCTTCAGTCAGATCAAGAGG | 110 |
|  | We4631 | CCTCTTGATCTGACTGAAGGCAAGTATTTTCTGGAATTGTGGTGGC | 111 |
| Q1656C | We4634 | CACAATTCCAGAAAATACTACTCTTTGCTCAGATCAAGAGGAAATTGAC | 112 |
|  | We4635 | GTCAATTTCCTCTTGATCTGAGCAAAGAGTAGTATTTTCTGGAATTGTG | 113 |
| D1658C | We4196 | CTACTCTTCAGTCATGTCAAGAGGAAATTGACTATGATGATACC | 58 |
|  | We4197 | GGTATCATCATAGTCAATTTCCTCTTGACATGACTGAAGAGTAG | 59 |
| E1660C | We4640 | CTACTCTTCAGTCAGATCAATGCGAAATTGACTATGATGATACCATATC | 114 |
|  | We4641 | GATATGGTATCATCATAGTCAATTTCGCATTGATCTGACTGAAGAGTAG | 115 |
| D1663C | We4198 | CAGTCAGATCAAGAGGAAATTTGCTATGATGATACCATATCAGTTG | 60 |
|  | We4199 | CAACTGATATGGTATCATCATAGCAAATTTCCTCTTGATCTGACTG | 61 |
| Y1664C | We4200 | GATCAAGAGGAAATTGACTGTGATGATACCATATCAGTTGAAATG | 62 |
|  | We4201 | CATTTCAACTGATATGGTATCATCACAGTCAATTTCCTCTTGATC | 63 |
| D1665C | We4202 | GATCAAGAGGAAATTGACTATTGTGATACCATATCAGTTGAAATGAAGAAGG | 64 |
|  | We4203 | CCTTCTTCATTTCAACTGATATGGTATCACAATAGTCAATTTCCTCTTGATC | 65 |

-continued

| FVIII mutation | Designation | Mutagenesis oligonucleotide sequence (5'→3') | SEQ ID NO |
|---|---|---|---|
| D1666C | We4204 | GATCAAGAGGAAATTGACTATGATTGTACCATATCAGTTGAAATGAAGAAGG | 66 |
|  | We4205 | CCTTCTTCATTTCAACTGATATGGTACAATCATAGTCAATTTCCTCTTGATC | 67 |
| S1669C | We4650 | GAAATTGACTATGATGATACCATATGCGTTGAAATGAAGAAGGAAGATTTTG | 116 |
|  | We4651 | CAAAATCTTCCTTCTTCATTTCAACGCATATGGTATCATCATAGTCAATTTC | 117 |
| V1670C | We4652 | GACTATGATGATACCATATCATGCGAAATGAAGAAGGAAGATTTTGAC | 118 |
|  | We4653 | GTCAAAATCTTCCTTCTTCATTTCGCATGATATGGTATCATCATAGTC | 119 |
| E1671C | We4206 | TGACTATGATGATACCATATCAGTTTGCATGAAGAAGGAAGATTTTGACATTTATG | 68 |
|  | We4207 | CATAAATGTCAAAATCTTCCTTCTTCATGCAAACTGATATGGTATCATCATAGTCA | 69 |
| M1672C | We4608 | GATGATACCATATCAGTTGAATGCAAGAAGGAAGATTTTGACATTTATG | 120 |
|  | We4609 | CATAAATGTCAAAATCTTCCTTCTTGCATTCAACTGATATGGTATCATC | 121 |
| K1673C | We4610 | GATACCATATCAGTTGAAATGTGCAAGGAAGATTTTGACATTTATGATG | 122 |
|  | We4611 | CATCATAAATGTCAAAATCTTCCTTGCACATTTCAACTGATATGGTATC | 123 |
| K1674C | We4612 | CCATATCAGTTGAAATGAAGTGCGAAGATTTTGACATTTATGATGAGGATG | 124 |
|  | We4613 | CATCCTCATCATAAATGTCAAAATCTTCGCACTTCATTTCAACTGATATGG | 125 |
| E1675C | We4208 | GATGATACCATATCAGTTGAAATGAAGAAGTGCGATTTTGACATTTATGATGAGG | 70 |
|  | We4209 | CCTCATCATAAATGTCAAAATCGCACTTCTTCATTTCAACTGATATGGTATCATC | 71 |
| D1676C | We4210 | GATACCATATCAGTTGAAATGAAGAAGGAATGTTTTGACATTTATGATGAGGATG | 72 |
|  | We4211 | CATCCTCATCATAAATGTCAAAACATTCCTTCTTCATTTCAACTGATATGGTATC | 73 |
| F1677C | We4614 | CAGTTGAAATGAAGAAGGAAGATTGCGACATTTATGATGAGGATGAAAATCAG | 126 |
|  | We4615 | CTGATTTTCATCCTCATCATAAATGTCGCAATCTTCCTTCTTCATTTCAACTG | 127 |
| D1678C | We4212 | GAAATGAAGAAGGAAGATTTTTGCATTTATGATGAGGATGAAAATCAGAGCCC | 74 |
|  | We4213 | GGGCTCTGATTTTCATCCTCATCATAAATGCAAAAATCTTCCTTCTTCATTTC | 75 |
| I1679C | We4294 | GAAATGAAGAAGGAAGATTTTGACTGTTATGATGAGGATGAAAATCAGAGCCC | 76 |
|  | We4295 | GGGCTCTGATTTTCATCCTCATCATAACAGTCAAAATCTTCCTTCTTCATTTC | 77 |
| Y1680C | We4214 | GAAGAAGGAAGATTTTGACATTTGCGATGAGGATGAAAATCAGAGCC | 78 |
|  | We4215 | GGCTCTGATTTTCATCCTCATCGCAAATGTCAAAATCTTCCTTCTTC | 79 |
| D1681C | We4616 | GAAGAAGGAAGATTTTGACATTTATTGCGAGGATGAAAATCAGAGCCCCC | 128 |
|  | We4617 | GGGGGCTCTGATTTTCATCCTCGCAATAAATGTCAAAATCTTCCTTCTTC | 129 |
| E1682C | We4216 | GGAAGATTTTGACATTTATGATTGCGATGAAAATCAGAGCCCCCGCAG | 80 |
|  | We4217 | CTGCGGGGGCTCTGATTTTCATCGCAATCATAAATGTCAAAATCTTCC | 81 |
| D1683C | We4618 | GGAAGATTTTGACATTTATGATGAGTGCGAAAATCAGAGCCCCCGCAG | 130 |
|  | We4619 | CTGCGGGGGCTCTGATTTTCGCACTCATCATAAATGTCAAAATCTTCC | 131 |
| E1684C | We4620 | GGAAGATTTTGACATTTATGATGAGTGCGAAAATCAGAGCCCCCGCAG | 132 |
|  | We4621 | CTGCGGGGGCTCTGATTTTCGCACTCATCATAAATGTCAAAATCTTCC | 133 |
| N1685C | We4622 | GGAAGATTTTGACATTTATGATGAGGATGAATGCCAGAGCCCCCGCAG | 134 |
|  | We4623 | CTGCGGGGGCTCTGGCATTCATCCTCATCATAAATGTCAAAATCTTCC | 135 |
| Q1686C | We4624 | GAAGATTTTGACATTTATGATGAGGATGAAAATTGCAGCCCCCGCAGC | 136 |
|  | We4625 | GCTGCGGGGGCTGCAATTTTCATCCTCATCATAAATGTCAAAATCTTC | 137 |
| S1687C | We4654 | CATTTATGATGAGGATGAAAATCAGTGCCCCCGCAGCTTTCAAAAG | 138 |
|  | We4655 | CTTTTGAAAGCTGCGGGGGCACTGATTTTCATCCTCATCATAAATG | 139 |
| P1688C | We4656 | TGATGAGGATGAAAATCAGAGCTGCCGCAGCTTTCAAAAGAAAACACG | 140 |
|  | We4657 | CGTGTTTTCTTTTGAAAGCTGCGGCAGCTCTGATTTTCATCCTCATCA | 141 |

Using the protocols and plasmids described above and in WO 2004/067566 by applying molecular biology techniques known to those skilled in the art (and as described e.g. in Current Protocols in Molecular Biology, ibid) any other constructs can be made by the artisan for mutation of any other amino acid residue within the a3 domain of FVIII.

The following table lists residues interchanged with cysteine in Factor VIII a3, C1 and C2 domains.

| Cystein residues in Factor VIII SingleChain | |
|---|---|
| T | 1653 |
| T | 1654 |
| L | 1655 |
| Q | 1656 |
| S | 1657 |
| D | 1658 |
| Q | 1659 |
| E | 1660 |

| Cystein residues in Factor VIII SingleChain | |
|---|---|
| E | 1661 |
| I | 1662 |
| D | 1663 |
| Y | 1664 |
| D | 1665 |
| D | 1666 |
| T | 1667 |
| I | 1668 |
| S | 1669 |
| V | 1670 |
| E | 1671 |
| M | 1672 |
| K | 1673 |
| K | 1674 |
| E | 1675 |
| D | 1676 |
| F | 1677 |
| D | 1678 |
| I | 1679 |
| Y | 1680 |
| D | 1681 |
| E | 1682 |
| D | 1683 |
| E | 1684 |
| N | 1685 |
| Q | 1686 |
| S | 1687 |
| P | 1688 |
| R | 1689 |
| I | 2098 |
| S | 2119 |
| N | 2129 |
| R | 2150 |
| P | 2153 |
| W | 2229 |
| Q | 2246 |

Example 3

Generation of Expression Vectors for FVIII Molecules with VWF-Derived C-Terminal Extensions FVIII molecules with VWF domains or fragments added to its carboxyterminus were generated by molecular biology methods known to those skilled in the art. These were used to cotransfect with VWF-FP to generate heterodimers containing modified FVIII and VWF-FP which were covalently linked via the CK domains at the C-terminus of both proteins.

```
For that FVIII cDNA was amplified by primers
We4323
                                        (SEQ ID NO: 82)
GTGGCTAGCGCATGGAAATAGAGCTCTCCAC We4324
                                        (SEQ ID NO: 83)
CACGCGGCCGCGTTACCGGTGTAGAGGTCCTGTGCCTCGC
``` and the resulting PCR fragment was inserted into a suitable expression vector, e.g. pIRESpuro3 (ibid) opened by NheI and NotI. Through the resulting AgeI and NotI sites the coding sequence of the VWF-derived C-terminal domains C3-C4-C5-C6-CK (VWF amino acids 2400 to 2813), C5-C6-CK (VWF amino acids 2544 to 2813) or of the CK domain alone (VWF amino acids 2724 to 2813) that had been amplified by PCR using primer pairs

```
We4264
                                        (SEQ ID NO: 84)
GTGACCGGTAACTCCACAGTGAGCTGTCCC

We4267
                                        (SEQ ID NO: 85)
ACAGCGGCCGCTATCACTTGCTGCACTTCCTGG
and We4265
                                       (SEQ ID NO: 142)
GTGACCGGTCAAAGGAACGTCTCCTGCCC We4267
                                        (SEQ ID NO: 85)
ACAGCGGCCGCTATCACTTGCTGCACTTCCTGG
and We4266
                                        (SEQ ID NO: 86)
GTGACCGGTTGCAACGACATCACTGCCAG We4267
                                        (SEQ ID NO: 85)
ACAGCGGCCGCTATCACTTGCTGCACTTCCTGG,
``` respectively, were inserted. This resulted in expression vectors containing FVIII cDNA with C-terminal extensions by VWF C-terminal domains C3-C4-C5-C6-CK, C5-C6-CK or CK, respectively.

Into the AgeI restriction site cleavable linker sequences were introduced which would release the FVIII from the VWF-FP during FVIII activation. The linker sequences were chosen from sequences surrounding one of the thrombin cleavage sites of FVIII, but any other thrombin cleavage site could be used as well (e.g. as described in WO 03/035861). As an example thrombin cleavage sites 372 and 1689 are represented by the following cDNA sequences:

```
CS372 (SEQ ID NO: 87):
5'ACCGGTGATGACAACTCTCCTTCCTTTATCCAAATTCGCTCAGTTG
CCAAGAAGCATCCTAAAACTTGGACCGGT3'

CS1689 (SEQ ID NO: 88):
5'ACCGGTGATGAGGATGAAAATCAGAGCCCCCGCAGCTTTCAAAAGA
AAACACGACACTATTTTATTGCTGCAGTGGAGAGGCTCTGGACCGGT3'
```

These sequences can be amplified by suitable PCR primers containing AgeI restriction sites at their termini. PCR fragments are then cleaved by AgeI and inserted into AgeI opened expression vectors as described above.

Similar approaches can be used by the artisan to construct expression plasmids containing FVIII cDNA molecules where its B domain or parts of it have been replaced by the VWF D'D3 region or where the VWF D'D3 region is connected directly or via a linker to the N-terminus or C-terminus of FVIII.

Example 4

Transfection of Plasmids for Stable Expression of VWF Mutants in CHO Cells

Expression plasmids based on pIRESneo3 were grown up in XL10 Gold (Agilent Technologies) and purified using standard protocols (Qiagen, Hilden, Germany).

CHO cells, preferably CHO-K1, were transfected using standard methods, for example nucleofection or lipofection, and single clones expressing the desired VWF-FP mutant were selected.

For proper VWF propeptide cleavage an expression plasmid encoding protease furin (NM002569.2) is cotransfected together with the VWF plasmid in a molar ratio of 1:4 (furin:VWF mutant).

Example 5

Transfection of CHO Cells Expressing VWF-FP Mutants and Transient Expression of FVIII Mutants FVIII mutant expression plasmids were purified as described above. Transient transfections into the stable VWF-FP mutant CHO clones (example 4) were conducted according to standard methods.

Harvest of transient transfections was performed by centrifugation to separate the cells from supernatant. Aliquots of the supernatant were generated and the recombinant product was characterized.

The following table describes representative results from transient transfections of FVIII mutant expression plasmids (column 1) into CHO cells stably expressing VWF-FP mutants (column 2). The results have been selected so that the ratio of covalently linked FVIII antigen to total FVIII activity (column 7) or the ratio of covalently linked FVIII antigen to total FVIII antigen (column 8) are equal to or greater than 1.0, which we have used as the selection criteria for the most preferred mutant combinations.

The amount of covalently linked FVIII antigen has been determined by the assay described in example 6, FVIII and VWF activity and antigen by assays as described in examples 9 and 10.

Example 6

Detection of FVIII Mutants Covalently Attached to VWF Mutants by Elisa

Cell culture supernatant samples (10 ml) from transient transfections were concentrated with Amicon Ultracell-30K (Millipore UFC903024; 3000 g centrifugation). FVIII covalently attached to VWF-FP in culture supernatant (concentrates) was determined by a standard ELISA. Briefly, microplates were incubated with 100 µL per well of the capture antibody (rabbit anti human VWF-IgG, Dako A0082 [Dako, Hamburg, Germany], diluted 1:2000 in buffer A [Sigma C3041, Sigma-Aldrich, Munich, Germany]) overnight at ambient temperature. After washing plates three times with buffer B (Sigma T9039), each well was incubated with 200 µL buffer C (Sigma T6789) for 1.5 hours at ambient temperature (blocking). After another three wash steps with buffer B, serial dilutions of the test sample in buffer B as well as serial dilutions of a control preparation of covalently linked FVIII-VWF-FP, (2.0-0.03 arbitrary U/ml in buffer B (we call these "arbitrary units" as they may not correspond to the standard FVIII units as determined using Standard Human Plasma); volumes per well: 100 µL) were incubated for 1.5 hours at ambient temperature. After three wash steps with buffer B, 200 µL of 350 mM $CaCl_2$ were added to each well and incubated for 1 hour at ambient temperature. $CaCl_2$ was removed (without washing) and additional 200 µl were added to each well and incubated further for 1 hour. After three wash steps with buffer B 100 µL of a 1:2 dilution in buffer B of the detection antibody (Detecting Antibody for FVIII:C, peroxidase labelled, Cedarlane CL20035K-D) were added to each well and incubated for 1 hour at ambient temperature. After three wash steps with buffer B, 100 µL of substrate solution (OUVF, Siemens Healthcare Diagnostics)

| Cys residue at FVIII aa position | Cys residue at VWF aa position | covalent FVIII [amU/ml][1] | FVIII activity [mU/ml] | FVIII antigen [mU/ml] | VWF antigen [mU/ml] | ratio covalent FVIII/ Total FVIII activity | ratio covalent FVIII/Total FVIII antigen | ratio FVIII activity/ FVIII antigen |
|---|---|---|---|---|---|---|---|---|
| 1654 | 1079 | 409 | 257 | 421 | 12 | 1.59 | 0.97 | 0.61 |
| 1654 | 1134 | 424 | 371 | 495 | 56 | 1.14 | 0.85 | 0.75 |
| 1656 | 1134 | 435 | 981 | 436 | 66 | 0.44 | 1.00 | 2.25 |
| 1677 | 1116 | 1076 | 649 | 1361 | 1208 | 1.66 | 0.79 | 0.48 |
| 1679 | 1079 | 398 | 316 | 349 | 12 | 1.26 | 1.14 | 0.91 |
| 1679 | 1116 | 992 | 889 | 1171 | 1400 | 1.12 | 0.85 | 0.76 |
| 1681 | 768 | 87 | 58 | 56 | 71 | 1.50 | 1.55 | 1.04 |
| 1681 | 1116 | 1440 | 2414 | 646 | 1405 | 0.60 | 2.23 | 3.74 |
| 1682 | 768 | 328 | 156 | 147 | 93 | 2.11 | 2.23 | 1.06 |
| 1682 | 1116 | 488 | 1424 | 397 | 1575 | 0.34 | 1.23 | 3.59 |
| 1683 | 768 | 2209 | 543 | 721 | 86 | 4.07 | 3.07 | 0.75 |
| 1683 | 1116 | 1346 | 3190 | 767 | 1475 | 0.42 | 1.76 | 4.16 |
| 1684 | 768 | 491 | 467 | 711 | 63 | 1.05 | 0.69 | 0.66 |
| 1684 | 1116 | 1150 | 2996 | 752 | 1548 | 0.38 | 1.53 | 3.98 |
| 1684 | 1134 | 741 | 844 | 236 | 63 | 0.88 | 3.15 | 3.58 |
| 1686 | 768 | 506 | 490 | 997 | 75 | 1.03 | 0.51 | 0.49 |
| 1686 | 1015 | 1639 | 1360 | 2568 | 331 | 1.21 | 0.64 | 0.53 |
| 1686 | 1116 | 2744 | 3180 | 523 | 1484 | 0.86 | 5.24 | 6.08 |
| 1686 | 1134 | 693 | 914 | 128 | 71 | 0.76 | 5.43 | 7.16 |
| 1687 | 768 | 390 | 271 | 797 | 77 | 1.44 | 0.49 | 0.34 |
| 1687 | 1134 | 843 | 804 | 411 | 65 | 1.05 | 2.05 | 1.95 |
| 1688 | 768 | 2058 | 110 | 968 | 69 | 18.75 | 2.13 | 0.11 |
| 1688 | 817 | 367 | 194 | 1279 | 1636 | 1.89 | 0.29 | 0.15 |
| 1688 | 984 | 1904 | 777 | 1974 | 438 | 2.45 | 0.96 | 0.39 |
| 1688 | 1015 | 1083 | 680 | 2053 | 390 | 1.59 | 0.53 | 0.33 |
| 1688 | 1116 | 666 | 1083 | 353 | 1654 | 0.61 | 1.89 | 3.07 |
| 1688 | 1134 | 650 | 348 | 106 | 62 | 1.87 | 6.11 | 3.27 |
| 2129 | 817 | 292 | 285 | 898 | 1789 | 1.02 | 0.33 | 0.32 |

[1]arbitrary milli-Unit per ml were added per well and incubated for 15 minutes at ambient temperature in the dark. Addition of 100 μL undiluted stop dilution (OSFA, Siemens Healthcare Diagnostics) prepared the samples for reading in a suitable microplate reader at 450 nm wavelength. Concentrations of the test samples were then calculated using the standard curve with the control preparation.

Example 7

Detection of FVIII Mutants Covalently Attached to VWF Mutants by Western Blot and Coomassie Stain Alternatively covalent complexes were detected by staining or Western blotting. Samples were examined with denaturing SDS-PAGE under reducing or non-reducing conditions and subsequent Western blot. For the detection of FVIII, an in house murine anti-FVIII monoclonal antibody mix followed by an alkaline phosphatase coupled secondary anti-mouse antibody (Invitrogen) and for VWF detection an HRP labeled polyclonal rabbit anti-human VWF (Fa. Dako P0226) antibody were used.

FIGS. 8A and 8B show the Western blot analysis of FVIII (FVIII-SingleChain) covalently linked to rVWF-FP dimers by the two principles described above from a non-reduced SDS-PAGE. FIG. 8A has been detected using anti-FVIII antibodies, FIG. 8B using anti-VWF antibodies. Lane 1 represents material linked where the FVIII moiety is linked to a VWF-FP dimer by a VWF derived C3-C4-C5-C6-CK sequence added to its C-terminus and an additional thrombin cleavage site between FVIII and the C3-C4-C5-C6-CK sequence. It had a ratio of covalent FVIII as measured by the specific Elisa described in example 8 to total FVIII activity of 5.78 and to total FVIII antigen of 7.47. High molecular weight bands above 460 kDa are visualized by both anti-FVIII and anti-VWF antibodies and demonstrate the presence of covalently linked FVIII-VWF-FP complexes. M denotes the molecular size marker. Lanes 2 and 3 represent control preparations of FVIII-SC and VWF-FP, respectively.

Lanes 4 and 5 represent covalent complexes linked through disulfide bridges between FVIII a3 and VWF-FP D3 domains by respective Cys mutations. Lane 4 represents FVIII-SC I1679C mutant on VWF-FP E1078C mutant. Lane 5 represents FVIII-SC I1675C mutant on VWF-FP E1078C mutant. Lane 6 is a control preparation only containing VWF-FP mutant E1078C. The blot demonstrates the presence of high molecular weight FVIII-VWF-FP complexes covalently linked to each other besides free FVIII molecules.

FIG. 9 shows a reduced SDS-PAGE stained with Gelcode Blue Stain reagent. Lane 1 contains a purified FVIII (FVIII-SingleChain) covalently linked to a rVWF-FP dimer, lane 2 shows the same preparation after thrombin digest releasing the covalently linked FVIII moiety in the linker sequence while in parallel activating FVIII. The bands in lane 1 represent the covalent complex and FVIII dimers, the prominent band in lane 2 between the 268 and 460 kDa markers represents the VWF-FP moiety, while the bands in the below 71 KDa range represent FVIII fragments.

Example 8

Chemical Crosslinking of FVIII to VWF

FVIII is reacted in an aqueous buffer solution containing preferably physiological NaCl and $CaCl_2$ concentrations at a constant temperature of preferably between 4° C. and 37° C. with a bi-specific bis-succinimide ester (PEG)n with a molecular weight of between 500 Da and 100 kDa in a molar ratio of FVIII and cross-linker of 2:1 to 1:1000 (preferred about 1:1). The FVIII concentration is preferably low to minimize cross-linking of FVIII with itself. After a period of 1 min to 60 min a half-life extended VWF is added to the FVIII solution in a molar excess of 2:1 to 200:1 based on the monomer building units of VWF. After an incubation period of 1 to 300 min at the temperature given above the residual reagent is quenched using preferably a low molecular weight compound containing a primary amino group and the covalent complex of FVIII and VWF is purified by methods known to the expert in the field, removing non-reacted FVIII or oligomers of FVIII and non-reacted VWF. The reaction times and temperatures for the different incubation steps are optimized by methods known to the expert in the field, e.g. by using SDS-PAGE/Western blot analysis with anti-FVIII or anti-VWF antibodies with the goal to maximize the content of the desired covalent complex and to minimize the content of side products.

Different reagents can be used for the chemical cross-linking of modified FVIII and VWF molecules. They are based on the cross-linking of different reactive groups of FVIII and VWF:
  a) Amine-to-Amine cross-linkers (e.g. bis-Imidoester (PEG)n or bis-succinimide ester(PEG)n)
  b) Carboxyl-to-Carboxyl cross-linkers
  c) Sufhydryl-to-Sulfhydryl cross-linkers (e.g. bis-maleimide(PEG)n)
  d) Carbohydrate-to-Carbohydrate cross-linkers
  e) Amine-to-Sulfhydryl cross-linkers
  f) Sulfhydryl-to-Carbohydrate cross-linkers
  g) Sulfhydryl-to-Hydroxyl cross-linkers
  h) Carboxyl-to-Amine cross-linkers Example 9

Analysis of Factor VIII Activity and Antigen

For activity determination of FVIII:C in vitro either a clotting assay (e.g. Pathromtin SL reagent and FVIII deficient plasma delivered by Dade Behring, Germany) or a chromogenic assay (e.g. Coamatic FVIII:C assay delivered by Haemochrom) are used. The assays are performed according to the manufacturers' instructions.

FVIII antigen (FVIII:Ag) is determined by a standard ELISA. Briefly, microplates are incubated with 100 μL per well of the capture antibody (sheep anti-human FVIII IgG, Cedarlane CL20035K-C, diluted 1:200 in Buffer A [Sigma C3041]) for 2 hours at ambient temperature. After washing plates three times with buffer B (Sigma P3563), serial dilutions of the test sample in sample diluent buffer (Cedarlane) as well as serial dilutions of a FVIII preparation (CSL Behring; 200-2 mU/mL) in sample diluent buffer (volumes per well: 100 μL) are incubated for two hours at ambient temperature. After three wash steps with buffer B, 100 μL of a 1:2 dilution in buffer B of the detection antibody (sheep anti-human FVIII IgG, Cedarlane CL20035K-D, peroxidase labelled) are added to each well and incubated for another hour at ambient temperature. After three wash steps with buffer B, 100 μL of substrate solution (1:10 (v/v) TMB OUVF:TMB Buffer OUVG, Dade Behring) are added per well and incubated for 30 minutes at ambient temperature in the dark. Addition of 100 μL stop solution (Dade Behring, OSFA) prepares the samples for reading in a suitable microplate reader at 450 nm wavelength. Concentrations of test samples are then calculated using the standard curve with the FVIII preparation as reference.

Example 10

Analysis of VWF Activity and Antigen

Samples are analysed by immunoturbidimetric determination of VWF:Ag (OPAB03, Siemens Healthcare Diagnostics, Marburg, Germany) and for collagen binding (Technozym VWF:CBA ELISA, Ref. 5450301 with calibrator set 5450310 and control set 5450312, Technoclone, Vienna, Austria) as described by the manufacturer.

VWF:RCo testing is done using the BC VWF reagent of Siemens Healthcare Diagnostics, Marburg, Germany according to the manufacturer's description. The International Concentrate Standard is used as a primary standard preparation to calibrate an in-house standard preparation for day to day use.

For pharmacokinetic analyses VWF antigen is determined by a standard ELISA. Briefly, microplates are incubated with 100 μL per well of the capture antibody (rabbit anti human vWF-IgG, Dako A0082 [Dako, Hamburg, Germany], diluted 1:2000 in buffer A [Sigma C3041, Sigma-Aldrich, Munich, Germany]) overnight at ambient temperature. After washing plates three times with buffer B (Sigma P3563), each well is incubated with 200 μL buffer C (Sigma P3688) for 1.5 hours at ambient temperature (blocking). After another three wash steps with buffer B, serial dilutions of the test sample in buffer B as well as serial dilutions of standard human plasma (ORKL21; 20-0.2 mU/mL; Siemens Healthcare Diagnostics, Marburg, Germany) in buffer B (volumes per well: 100 μL) are incubated for 1.5 hours at ambient temperature. After three wash steps with buffer B, 100 μL of a 1:16000 dilution in buffer B of the detection antibody (rabbit anti human vWF-IgG, Dako P0226, peroxidase labelled) are added to each well and incubated for 1 hour at ambient temperature. After three wash steps with buffer B, 100 μL of substrate solution (OUVF, Siemens Healthcare Diagnostics) are added per well and incubated for 30 minutes at ambient temperature in the dark. Addition of 100 μL undiluted stop dilution (OSFA, Siemens Healthcare Diagnostics) prepares the samples for reading in a suitable microplate reader at 450 nm wavelength. Concentrations of the test samples are then calculated using the standard curve with standard human plasma as reference.

Example 11

VWF Multimer Analysis

VWF multimer analysis was performed by SDS-agarose gel electrophoresis as recently described (Tatewaki et al., Thromb. Res. 52: 23-32 (1988), and Metzner et al., Haemophilia 4 (Suppl. 3): 25-32 (1998)) with minor modifications. Briefly, after equilibration in running buffer ready to use 1% agarose mini gels (BioRad) were used to standardize the method as far as possible. Comparable amounts of VWF antigen were subjected to electrophoresis on the SDS-agarose gels. After Western blotting the protein bands were detected using anti-VWF, anti-FVIII or anti-albumin antibodies followed by alkaline phosphatase labelled anti-IgG antibodies (SIGMA, prod. No. 1305) and colour reaction quantified by densitometry.

Two preparations of covalent FVIII-SC/VWF-FP multimer complexes were analysed by multimer gel analysis. Lanes 2 and 3 of FIGS. 10A and 10B represent material wherein the FVIII moiety is linked to a VWF-FP multimer by a VWF derived C3-C4-C5-C6-CK sequence added to its C-terminus with an additional thrombin cleavage site between FVIII and the C3-C4-C5-C6-CK sequence (example 3). Lane 1 represents plasma-derived VWF, lane 4 VWF-FP. The results demonstrate that covalent FVIII/VWF-FP complexes do multimerize to an extent similar to VWF-FP or natural VWF. Additional bands represent the addition of one or more covalent FVIII molecules. Most multimer bands detected by anti-VWF antibodies (FIG. 10A) can also be stained by anti-FVIII (FIG. 10B), demonstrating covalent FVIII/VWF-FP multimers.

Example 12

Purification of Covalently Linked FVIII/VWF-FP Complexes

Cell culture supernatants containing covalently linked FVIII/VWF-FP dimer complexes are sterile-filtered through a 0.2 μm filter and concentrated with a 30 kDa UF unit (Centramate™, Pall) up to 20-fold. Cell culture supernatants containing covalently linked FVIII/VWF-FP multimer complexes are sterile-filtered through a 0.2 μm filter and concentrated with a Cadence™ Single-Use Inline Concentrator (30 kDa cut-off, Pall). This material is then applied to a Human Albumin Capture Select column (BAC) equilibrated with equilibration buffer (EB, 20 mM Tris pH 7.0). The column is washed with EB and FVIII/VWF-FP complexes are eluted with 2M $MgCl_2$ in EB. The elution peak is pooled and dialysed against running buffer of the SEC HiPrep Sephacryl S-500 High Resolution (GE Healthcare) containing 50 mM HEPES, 400 mM $CaCl_2$, 50 mM NaCl, pH 7, as described by McCue et al., 2009; J. Chrom. A, 1216(45): 7824-30 with minor modification). This material is then applied to a preequilibrated SEC HiPrep Sephacryl S-500 High Resolution (GE Healthcare) and after separating by size only the fractions containing the covalently linked FVIII/VWF-FP were pooled and SEC HiPrep Sephacryl S-500 High Resolution (GE Healthcare). This pool is dialysed against 1.7 mM $CaCl_2$, 10 mM L-His, 308 mM NaCl, 8.76 mM saccharose, 0.01% Tween 80, pH 7. Finally the material is frozen in aliquots.

Alternatively for certain constructs the VIIISelect column (GE Healthcare) may provide better purification results than the Human Albumin Capture Select Column. In such case, the cell culture supernatant concentrate is applied to a preequilibrated VIIISelect column (GE Healthcare) and after washing with equilibration buffer (10 mM HEPES, 5 mM $CaCl_2$, 150 mM NaCl, 0.03% Tween80 pH 7), it is followed by equilibration buffer with a high salt concentration (1 M NaCl) and then again by equilibration buffer. The FVIII/VWF-FP complexes are eluted with 20 mM L-His, 5 mM $CaCl_2$, 150 mM NaCl, 60% ethylene glycol, 0.03% Tween 80, pH 7. The elution peak is pooled and dialysed against the running buffer of the subsequent SEC column, containing 50 mM HEPES, 400 mM $CaCl_2$, 50 mM NaCl, pH 7. This material is then applied to a preequilibrated SEC HiPrep Sephacryl S-500 High Resolution (GE Healthcare) column. Fractions containing the covalently linked FVIII/VWF-FP are pooled. This pool is dialysed against 1.7 mM $CaCl_2$, 10 mM L-His, 308 mM NaCl, 8.76 mM saccharose, 0.01% Tween 80, pH 7. Finally the material is frozen in aliquots.

Example 13

Pharmacokinetic Analysis of Covalently Linked FVIII/VWF Complexes in FVIII Deficient Mice and in Rats The FVIII/VWF complexes are administered intravenously to FVIII deficient mice (12 mice per substance) with a dose of 100 IU (FVIII:Ag)/kg body weight. Blood samples are drawn at appropriate intervals using an alternating sampling scheme, resulting in samples from 3 animals/timepoint (t=0 min and 16 h for subset No 1, 5 min and 24 h for subset No 2, 2 h and 4 h for subset No 3, and 8 h and 32 h for subset No 4). The scheme is designed to minimize potential effects of blood sampling on the plasma concentration to be quantified. Blood is processed to plasma and stored deep frozen until analysis. FVIII and VWF antigen content is subsequently quantified by specific ELISA assays (see examples 7, 9 and 10). The mean values of the treatment groups are used to calculate in vivo recovery after 5 min. Half-lives are calculated using the time points of the beta phase of elimination according to the formula $t_{1/2}=\ln 2/k$, whereas k is the slope of the regression line. Antigen is usually used as a measure in pharmacokinetic studies. It is expected that antigen and functional activity will correlate.

The FVIII/VWF complexes are administered intravenously to narcotized CD/Lewis rats (6 rats per substance) with a dose of 100 IU (VWF:Ag)/kg body weight. Blood samples are drawn at appropriate intervals starting at 5 minutes after application of the test substances using an alternating sampling scheme, resulting in samples from 3 animals/timepoint (t=0, 5, 30, 90 min, 4 h, 1 d for subset Nr. 1 and 0, 15 min, 1, 2, 8 h and 2 d for subset Nr. 2). The scheme is designed to minimize potential effects of blood sampling on the plasma concentration to be quantified. Blood is processed to plasma and stored deep frozen until analysis. FVIII and VWF antigen content is subsequently quantified by specific ELISA assays (see above). The mean values of the treatment groups are used to calculate in vivo recovery after 5 min. Half-lives are calculated using the time points of the beta phase of elimination according to the formula $t_{1/2}=\ln 2/k$, whereas k is the slope of the regression line. Antigen is usually used as a measure in pharmacokinetic studies in normal animals in order to eliminate the background of the intrinsic FVIII activity in the animals from the measurements. It is expected that antigen and functional activity will correlate.

A covalent FVIII/VWF-FP preparation consisting of a single-chain FVIII sequence with the VWF C3 to C6 and CK domains attached to its carboxyterminus via a cleavable linker and an albumin-fused VWF (as described in example 3) were tested for their half-lives in a rat PK model. FIGS. 11A and 11B show the elimination kinetics of the covalent complex (circles, named FVIII-CK+VWF-FP in the figure legend) in comparison to a recombinant FVIII (Advate, squares in FIG. 11A), a VWF-FP (squares in FIG. 11B) and a plasma-derived FVIII-VWF complex (Haemate, triangles). FIG. 11A shows the FVIII data (the covalent complex being measured by the specific Elisa as described in example 6; all other compounds were measured by FVIII Elisa), FIG. 11B shows the data of a VWF Elisa. The elimination kinetics of the covalent construct were similar when FVIII and VWF antigen were measured, as expected when both moieties were covalently attached. The terminal half-life for FVIII antigen was calculated to be 7.9 hours, that of VWF 7.8 hours. Surprisingly the terminal half-life calculated for the VWF-FP control (VWF antigen) was very similar, 8.1 hours. Clearance rates were also similar with 9.8 IU/mL/h for the covalent complex and 10.1 IU/mL/h for VWF-FP. The half-life of rFVIII (Advate) was calculated with 2.5 hours, which would result in an about 3-fold half-life extension of the covalent complex over free FVIII.

These results indicate that the covalent attachment of a FVIII sequence to a half-life extended VWF molecule does extend the half-life of that FVIII molecule significantly and to an extent that it resembles the half-life of the unfused half-life extended VWF molecule.

SEQUENCE LISTING (177 sequences)

SEQ ID NO: 1 - DNA, 8442 bp, Homo sapiens
atgattcctgccagatttgccggggtgctgcttgctctggccctcattttgccagggaccctttgtgcagaaggaactcgcggcaggtcatccacggcccgatgcagccttttcggaagtgacttcgtcaacacctttgatgggagcatgtacagctttgcgggatactgcagttacctcctggcagggggctgccagaaacgctccttctcgattattggggacttccagaatggcaagagagtgagcctctccgtgtatcttggggaattttttgacatccatttgtttgtcaatggtaccgtgacacagggggaccaaagagtctccatgccctatgcctccaaagggctgtatctagaaactgaggctgggtactacaagctgtccggtgaggcctatggctttgtggccaggatcgatggcagcggcaactttcaagtcctgctgtcagacagatacttcaacaagacctgcgggctgtgtggcaactttaacatctttgctgaagatgactttatgacccaagaagggaccttgacctcggacccttatgactttgccaactcatgggctctgagcagtggagaacagtggtgtgaacgggcatctcctcccagcagctcatgcaacatctcctctggggaaatgcagaagggcctgtgggagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgcccggacctgtgcccaggagggaatggtgctgtacggctggaccgaccacagcgcgtgcagcccagtgtgccctgctggtatggagtataggcagtgtgtgtccccttgcgccaggacctgccagagcctgcacatcaatgaaatgtgtcaggagcgatgcgtggatggctgcagctgccctgagggacagctcctggatgaaggcctctgcgtggagagcaccgagtgtccctgcgtgcattccggaaagcgctaccctcccggcacctccctctctcgagactgcaacacctgcatttgccgaaacagccagtggatctgcagcaatgaagaatgtccaggggagtgccttgtcacaggtcaatcacacttcaagagctttgacaacagatacttcaccttcagtgggatctgccagtacctgctggcccgggattgccaggaccactccttctccattgtcattgagactgtccagtgtgctgatgaccgcgacgctgtgtgcacccgctccgtcaccgtccggctgcctggcctgcacaacagccttgtgaaactgaagcatggggcaggagttgccatggatggccaggacgtccagctccccctcctgaaaggtgacctccgcatccagcatacagtgacggcctccgtgcgcctcagctacggggaggacctgcagatggactgggatggccgcgggaggctgctggtgaagctgtcccccgtctatgccgggaagacctgcggcctgtgtgggaattacaatggcaaccagggcgacgacttccttaccccctctgggctggcggagccccgggtggaggacttcgggaacgcctggaagctgcacggggactgccaggacctgcagaagcagcacagcgatccctgcgccctcaacccgcgcatgaccaggttctccgaggaggcgtgcgcggtcctgacgtcccccacattcgaggcctgccatcgtgccgtcagcccgctgccctacctgcggaactgccgctacgacgtgtgctcctgctcggacggccgcgagtgcctgtgcggcgccctggccagctatgccgcggcctgcgcggggagaggcgtgcgcgtcgcgtggcgcgagccaggccgctgtgagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggcccagtgcccctgttactatgacggtgagatcttccagccagaagacatcttctcagaccatcacaccatgtgctactgtgaggatggcttcatgcactgtaccatgagtggagtccccggaagcttgctgcctgacgctgtcctcagcagtcccctgtctcatcgcagcaaaaggagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggcctggtggtgcctcccacagatgccccggtgagccccaccactctgtatgtggaggacatctcggaaccgccgttgcacgatttctactgcagcaggctactggacctggtcttcctgctggatggctcctccaggctgtccgaggctgagtttgaagtgctgaaggcctttgtggtggacatgatggagcggctgcgcatctcccagaagtgggtccgcgtggccgtggtggagtaccacgacggctcccacgcctacatcgggctcaaggaccggaagcgaccgtcagagctgcggcgcattgccagccaggtgaagtatgcgggcagccaggtggcctccaccagcgaggtcttgaaatacacactgttccaaatcttcagcaagatcgaccgccctgaagcctcccgcatcgccctgctcctgatggccagccaggagccccaacggatgtcccggaactttgtccgctacgtccagggcctgaagaagaagaaggtcattgtgatcccggtgggcattgggccccatgccaacctcaagcagatccgcctcatcgagaagcaggcccctgagaacaaggccttcgtgctgagcagtgtggatgagctggagcagcaaagggacgagatcgttagctacctctgtgaccttgcccctgaagcccctcctcctactctgcccccccacatggcacaagtcactgtgggcccggggctcttgggggtttcgaccctggggcccaagaggaactccatggttctggatgtggcgttcgtcctggaaggatcggacaaaattggtgaagccgacttcaacaggagcaaggagttcatggaggaggtgattcagcggatggatgtgggccaggacagcatccacgtcacggtgctgcagtactcctacatggtgaccgtggagtaccccttcagcgaggcacagtccaaaggggacatcctgcagcgggtgcgagagatccgctaccagggcggcaacaggaccaacactgggctggccctgcggtacctctctgaccacagcttcttggtcagccagggtgaccgggagcaggcgcccaacctggtctacatggtcaccggaaatcctgcctctgatgagatcaagaggctgcctggagacatccaggtggtgcccattggagtgggccctaatgccaacgtgcaggagctggagaggattggctggcccaatgcccctatcctcatccaggactttgagacgctcccccgagaggctcctgacctggtgctgcagaggtgctgctccggagaggggctgcagatccccaccctctcccctgcacctgactgcagccagcccctggacgtgatccttctcctggatggctcctccagtttcccagcttcttattttgatgaaatgaagagtttcgccaaggctttcatttcaaaagccaatatagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggggatgccttgggctttgctgtgcgatacttgacttcagaaatgcatggggcgcgcccgggagcctcaaaggcggtggtcatcctggtcacggacgtctctgtggattcagtggatgcagcagctgatgccgccaggtccaacagagtgacagtgttccctattggaattggagatcgctacgatgcagcccagctacggatcttggcaggcccagcaggcgactccaacgtggtgaagctccagcgaatcgaagacctccctaccatggtcaccttgggcaattccttcctccacaaactgtgctctggatttgttaggatttgcatggatgaggatgggaatgagaagaggcccggggacgtctggaccttgccagaccagtgccacaccgtgacttgccagccagatggccagaccttgctgaagagtcatcgggtcaactgtgaccgggggctgaggccttcgtgccctaacagccagtcccctgttaaagtggaagagacctgtggctgccgctggacctgcccctgcgtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtgggatctgtgatgagaacggagccaatgacttcatgctgagggatggcacagtcaccacagactggaaaacacttgttcaggaatggactgtgcagcggccagggcagacgtgccagcccatcctggaggagcagtgtcttgtccccgacagctcccactgccaggtcctcctcttaccactgtttgctgaatgccacaaggtcctggctccagccacattctatgccatctgccagcaggacagttgccaccaggagcaagtgtgtgaggtgatcgcctcttatgcccacctctgtcggaccaacggggtctgcgttgactggaggacacctgatttctgtgctatgtcatgcccaccatctctggtttataaccactgtgagcatggctgtccccggcactgtgatggcaacgtgagctcctgtggggaccatccctccgaaggctgtttctgccctccagataaagtcatgttggaaggcagctgtgtccctgaagaggcctgcactcagtgcattggtgaggatggagtccagcaccagttcctggaagcctgggtcccggaccaccagccctgtcagatctgcacatgcctcagcgggcggaaggtcaactgcacaacgcagccctgccccacggccaaagctcccacgtgtggcctgtgtgaagtagcccgcctccgccagaatgcagaccagtgctgccccgagtatgagtgtgtgtgtgacccagtgagctgtgacctgcccccagtgcctcactgtgaacgtggcctccagcccacactgaccaaccctggcgagtgcagacccaacttcacctgcgcctgcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 2 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSSVDELEQQRDEIVSYLCDLAPEAPPPTLPPHMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 3 - DNA, 30 bp, Artificial Sequence
  PCR primer
ttcgaattcccgcagccctcatttgcaggg

SEQ ID NO: 4 - DNA, 31 bp, Artificial Sequence
  PCR primer
tccgaattccggcagcagcaggcacccatgc

SEQ ID NO: 5 - DNA, 7056 bp, Homo sapiens
atgcaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatgacatagagaagactgacccttggtttgcacacagaacacctatgcctaaaatacaaaatgtctcctctagtgatttgttgatgctcttgcgacagagtcctactccacatgggctatccttatctgatctccaagaagccaaatatgagactttttctgatgatccatcacctggagcaatagacagtaataacagcctgtctgaaatgacacacttcaggccacagctccatcacagtggggacatggtatttacccctgagtcaggcctccaattaagattaaatgagaaactggggacaactgcagcaacagagttgaagaaacttgatttcaaagtttctagtacatcaaataatctgatttcaacaattccatcagacaatttggcagcaggtactgataatacaagttccttaggacccccaagtatgccagttcattatgatagtcaattagataccactctatttggcaaaaagtcatctccccttactgagtctggtggacctctgagcttgagtgaagaaaataatgattcaaagttgttagaatcaggtttaatgaatagccaagaaagttcatggggaaaaaatgtatcgtcaacagagagtggtaggttatttaaagggaaaagagctcatggacctgctttgttgactaaagataatgccttattcaaagttagcatctctttgttaaagacaaacaaaacttccaataattcagcaactaatagaaagactcacattgatggcccatcattattaattgagaatagtccatcagtctggcaaaatatattagaaagtgacactgagtttaaaaaagtgacacctttgattcatgacagaatgcttatggacaaaaatgctacagctttgaggctaaatcatatgtcaaataaaactacttcatcaaaaaacatggaaatggtccaacagaaaaaagagggccccattccaccagatgcacaaaatccagatatgtcgttctttaagatgctattcttgccagaatcagcaaggtggatacaaaggactcatggaaagaactctctgaactctgggcaaggccccagtccaaagcaattagtatccttaggaccagaaaaatctgtggaaggtcagaatttcttgtctgagaaaaacaaagtggtagtaggaaagggtgaatttacaaaggacgtaggactcaaagagatggtttttccaagcagcagaaacctatttcttactaacttggataatttacatgaaaataatacacacaatcaagaaaaaaaaattcaggaagaaatagaaaagaaggaaacattaatccaagagaatgtagttttgcctcagatacatacagtgactggcactaagaatttcatgaagaaccttttcttactgagcactaggcaaaatgtagaaggttcatatgacggggcatatgctccagtacttcaagattttaggtcattaaatgattcaacaaatagaacaaagaaacacacagctcatttctcaaaaaaaggggaggaagaaaacttggaaggcttgggaaatcaaaccaagcaaattgtagagaaatatgcatgcaccacaaggatatctcctaatacaagccagcagaattttgtcacgcaacgtagtaagagagctttgaaacaattcagactcccactagaagaaacagaacttgaaaaaaggataattgtggatgacacctcaacccagtggtccaaaaacatgaaacatttgaccccgagcaccctcacacagatagactacaatgagaaggagaaaggggccattactcagtctcccttatcagattgccttacgaggagtcatagcatccctcaagcaaatagatctccattacccattgcaaaggtatcatcatttccatctattagacctatatatctgaccagggtcctattccaagacaactcttctcatcttccagcagcatcttatagaaagaaagattctggggtccaagaaagcagtcatttcttacaaggagccaaaaaaaataacctttctttagccattctaaccttggagatgactggtgatcaaagagaggttggctccctggggacaagtgccacaaattcagtcacatacaagaaagttgagaacactgttctcccgaaaccagacttgcccaaaacatctggcaaagttgaattgcttccaaaagttcacatttatcagaaggacctattccctacggaaactagcaatgggtctcctggccatctggatctcgtggaagggagccttcttcagggaacagagggagcgattaagtggaatgaagcaaacagacctggaaaagttccctttctgagagtagcaacagaaagctctgcaaagactccctccaagctattggatcctcttgcttgggataaccactatggtactcagataccaaaagaagagtggaaatcccaagagaagtcaccagaaaaaacagcttttaagaaaaaggataccattttgtccctgaacgcttgtgaaagcaatcatgcaatagcagcaataaatgagggacaaaataagcccgaaatagaagtcacctgggcaaagcaaggtaggactgaaaggctgtgctctcaaaacccaccagtcttgaaacgccatcaacgggaaataactcgtactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctactga

SEQ ID NO: 6 - protein, 2332 aa, Homo sapiens
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHRSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 7 - protein, 585 aa, Homo sapiens [sequence omitted]

SEQ ID NO: 8 - DNA, 35 bp, Artificial Sequence
  Primer for Mutagenesis
cccgctgacaacctgtgcgctgaagggctcgagtg

SEQ ID NO: 9 - DNA, 35 bp, Artificial Sequence
  Primer for Mutagenesis
cactcgagcccttcagcgcacaggttgtcagcggg

SEQ ID NO: 10 - DNA, 37 bp, Artificial Sequence
  Primer for Mutagenesis
caacctgcgggctgaatgcctcgagtgtaccaaaacg

SEQ ID NO: 11 - DNA, 37 bp, Artificial Sequence
  Primer for Mutagenesis
cgttttggtacactcgaggcattcagcccgcaggttg

SEQ ID NO: 12 - DNA, 35 bp, Artificial Sequence
  Oligonucleotide for Mutagenesis
gggctgaagggctctgctgtaccaaaacgtgccag

SEQ ID NO: 13 - DNA, 35 bp, Artificial Sequence
  Oligonucleotide for Mutagenesis
ctggcacgttttggtacagcagagcccttcagccc

SEQ ID NO: 14 - DNA, 36 bp, Artificial Sequence
  Oligonucleotide for Mutagenesis
gggctcgagtgttgcaaaacgtgccagaactatgac

SEQ ID NO: 15 - DNA, 36 bp, Artificial Sequence
  Oligonucleotide for Mutagenesis
gtcatagttctggcacgttttgcaacactcgagccc

SEQ ID NO: 16 - DNA, 39 bp, Artificial Sequence
  Oligonucleotide for Mutagenesis
gggctcgagtgtaccaaatgctgccagaactatgacctg

SEQ ID NO: 17 - DNA, 39 bp, Artificial Sequence
  Oligonucleotide for Mutagenesis
caggtcatagttctggcagcatttggtacactcgagccc

SEQ ID NO: 18 - DNA, 39 bp, Artificial Sequence
  Oligonucleotide for Mutagenesis
gagtgtaccaaaacgtgctgcaactatgacctggagtgc

SEQ ID NO: 19 - DNA, 39 bp, Artificial Sequence
  Oligonucleotide for Mutagenesis
gcactccaggtcatagttgcagcacgttttggtacactc

SEQ ID NO: 20 - DNA, 41 bp, Artificial Sequence
  Oligonucleotide for Mutagenesis
gtaccaaaacgtgccagtgctatgacctggagtgcatgagc

SEQ ID NO: 21 - DNA, 41 bp, Artificial Sequence
  Oligonucleotide for Mutagenesis
gctcatgcactccaggtcatagcactggcacgttttggtac

SEQ ID NO: 22 - DNA, 41 bp, Artificial Sequence
  Oligonucleotide for Mutagenesis
gtaccaaaacgtgccagaactgtgacctggagtgcatgagc

SEQ ID NO: 23 - DNA, 41 bp, Artificial Sequence
  Oligonucleotide for Mutagenesis
gctcatgcactccaggtcacagttctggcacgttttggtac

SEQ ID NO: 24 - DNA, 36 bp, Artificial Sequence
  Oligonucleotide for Mutagenesis
ctatgacctggagtgctgcagcatgggctgtgtctc

SEQ ID NO: 25 - DNA, 36 bp, Artificial Sequence
  Oligonucleotide for Mutagenesis
gagacacagcccatgctgcagcactccaggtcatag

SEQ ID NO: 26 - DNA, 35 bp, Artificial Sequence
  Oligonucleotide for Mutagenesis
ccccgggcatggtctgccatgagaacagatgtgtg

SEQ ID NO: 27 - DNA, 35 bp, Artificial Sequence
  Oligonucleotide for Mutagenesis
cacacatctgttctcatggcagaccatgcccgggg

SEQ ID NO: 28 - DNA, 34 bp, Artificial Sequence
  Oligonucleotide for Mutagenesis
gggcatggtccggtgtgagaacagatgtgtggcc

SEQ ID NO: 29 - DNA, 34 bp, Artificial Sequence
  Oligonucleotide for Mutagenesis
ggccacacatctgttctcacaccggaccatgccc

SEQ ID NO: 30 - DNA, 35 bp, Artificial Sequence
  Oligonucleotide for Mutagenesis
tggccctggaaaggtgttgctgcttccatcagggc

SEQ ID NO: 31 - DNA, 35 bp, Artificial Sequence
  Oligonucleotide for Mutagenesis
gccctgatggaagcagcaacacctttccagggcca

SEQ ID NO: 32 - DNA, 33 bp, Artificial Sequence
  Oligonucleotide for Mutagenesis
gaaaggtgtccctgctgccatcagggcaaggag

SEQ ID NO: 33 - DNA, 33 bp, Artificial Sequence
  Oligonucleotide for Mutagenesis
ctccttgccctgatggcagcagggacacctttc

SEQ ID NO: 34 - DNA, 36 bp, Artificial Sequence
  Oligonucleotide for Mutagenesis
cttccatcagggcaagtgctatgcccctggagaaac

SEQ ID NO: 35 - DNA, 36 bp, Artificial Sequence
  Oligonucleotide for Mutagenesis
gtttctccaggggcatagcacttgccctgatggaag

SEQ ID NO: 36 - DNA, 37 bp, Artificial Sequence
  Oligonucleotide for Mutagenesis
gggcaaggagtatgcctgtggagaaacagtgaagatt

SEQ ID NO: 37 - DNA, 37 bp, Artificial Sequence
  Oligonucleotide for Mutagenesis
aatcttcactgtttctccacaggcatactccttgccc

SEQ ID NO: 38 - DNA, 36 bp, Artificial Sequence
  Oligonucleotide for Mutagenesis
cacttgtgtctgtcggtgccggaagtggaactgcac

SEQ ID NO: 39 - DNA, 36 bp, Artificial Sequence
  Oligonucleotide for Mutagenesis
gtgcagttccacttccggcaccgacagacacaagtg

SEQ ID NO: 40 - DNA, 36 bp, Artificial Sequence
  Oligonucleotide for Mutaagenesis
cttgtgtctgtcgggactgcaagtggaactgcacag

SEQ ID NO: 41 - DNA, 36 bp, Artificial Sequence
  Oligonucleotide for Mutagenesis
ctgtgcagttccacttgcagtcccgacagacacaag

SEQ ID NO: 42 - DNA, 35 bp, Artificial Sequence
  Oligonucleotide for Mutagenesis
ctgtcgggaccggtgctggaactgcacagaccatg

SEQ ID NO: 43 - DNA, 35 bp, Artificial Sequence
  Oligonucleotide for Mutagenesis
catggtctgtgcagttccagcaccggtcccgacag

SEQ ID NO: 44 - DNA, 35 bp, Artificial Sequence
  Oligonucleotide for Mutagenesis
ctgtcgggaccggaagtgcaactgcacagaccatg

SEQ ID NO: 45 - DNA, 35 bp, Artificial Sequence
  Oligonucleotide for Mutagenesis
catggtctgtgcagttgcacttccggtcccgacag

SEQ ID NO: 46 - DNA, 38 bp, Artificial Sequence
  Oligonucleotide for Mutagenesis
ccactacctcaccttctgcgggctcaaatacctgttcc

SEQ ID NO: 47 - DNA, 38 bp, Artificial Sequence
  Oligonucleotide for Mutagenesis
ggaacaggtatttgagcccgcagaaggtgaggtagtgg

SEQ ID NO: 48 - DNA, 39 bp, Artificial Sequence
  Oligonucleotide for Mutagenesis
cctcagtgaaatgcaagaaatgcgtcaccatcctggtgg

SEQ ID NO: 49 - DNA, 39 bp, Artificial Sequence
  Oligonucleotide for Mutagenesis
ccaccaggatggtgacgcatttcttgcatttcactgagg

SEQ ID NO: 50 - DNA, 45 bp, Artificial Sequence
  Oligonucleotide for Mutagenesis
ctgccataacaacatcatgaagtgcacgatggtggattcctcctg

SEQ ID NO: 51 - DNA, 45 bp, Artificial Sequence
  Oligonucleotide for Mutagenesis
caggaggaatccaccatcgtgcacttcatgatgttgttatggcag

SEQ ID NO: 52 - DNA, 40 bp, Artificial Sequence
  Oligonucleotide for Mutagenesis
caacaagctggtggacccctgcccatatctggatgtctgc

SEQ ID NO: 53 - DNA, 40 bp, Artificial Sequence
  Oligonucleotide for Mutagenesis
gcagacatccagatatgggcaggggtccaccagcttgttg

SEQ ID NO: 54 - DNA, 35 bp, Artificial Sequence
  PCR primer
gccagggaccctttgtagcctatcctgtcggcccc

SEQ ID NO: 55 - DNA, 35 bp, Artificial Sequence
  PCR primer
ggggccgacaggataggctacaaagggtccctggc

SEQ ID NO: 56 - DNA, 29 bp, Artificial Sequence
  PCR primer
gtggctagcatggaaatagagctctccac

SEQ ID NO: 57 - DNA, 30 bp, Artificial Sequence
  PCR primer
cacgcggccgctcagtagaggtcctgtgcc

SEQ ID NO: 58 - DNA, 44 bp, Artificial Sequence
  Oligonucleotide for Mutagenesis
ctactcttcagtcatgtcaagaggaaattgactatgatgatacc

SEQ ID NO: 59 - DNA, 44 bp, Artificial Sequence
  Oligonucleotide for Mutagenesis
ggtatcatcatagtcaatttcctcttgacatgactgaagagtag

SEQ ID NO: 60 - DNA, 46 bp, Artificial Sequence
  Oligonucleotide for Mutagenesis
cagtcagatcaagaggaaatttgctatgatgataccatatcagttg

SEQ ID NO: 61 - DNA, 46 bp, Artificial Sequence
  Oligonucleotide for Mutagenesis
caactgatatggtatcatcatagcaaatttcctcttgatctgactg

SEQ ID NO: 62 - DNA, 45 bp, Artificial Sequence
  Oligonucleotide for Mutagenesis
gatcaagaggaaattgactgtgatgataccatatcagttgaaatg

SEQ ID NO: 63 - DNA, 45 bp, Artificial Sequence
  Oligonucleotide for Mutagenesis
catttcaactgatatggtatcatcacagtcaatttcctcttgatc

SEQ ID NO: 64 - DNA, 52 bp, Artificial Sequence
  Oligonucleotide for Mutagenesis
gatcaagaggaaattgactattgtgataccatatcagttgaaatgaagaagg

SEQ ID NO: 65 - DNA, 52 bp, Artificial Sequence
  Oligonucleotide for Mutagenesis
ccttcttcatttcaactgatatggtatcacaatagtcaatttcctcttgatc

SEQ ID NO: 66 - DNA, 52 bp, Artificial Sequence
  Oligonucleotide for Mutagenesis
gatcaagaggaaattgactatgattgtaccatatcagttgaaatgaagaagg

SEQ ID NO: 67 - DNA, 52 bp, Artificial Sequence
  Oligonucleotide for Mutagenesis
ccttcttcatttcaactgatatggtacaatcatagtcaatttcctcttgatc

SEQ ID NO: 68 - DNA, 56 bp, Artificial Sequence
  Oligonucleotide for Mutagenesis
tgactatgatgataccatatcagtttgcatgaagaaggaagattttgacatttatg

SEQ ID NO: 69 - DNA, 56 bp, Artificial Sequence
  Oligonucleotide for Mutagenesis
cataaatgtcaaaatcttccttcttcatgcaaactgatatggtatcatcatagtca

SEQ ID NO: 70 - DNA, 55 bp, Artificial Sequence
  Oligonucleotide for Mutagenesis
gatgataccatatcagttgaaatgaagaagtgcgattttgacatttatgatgagg

SEQ ID NO: 71 - DNA, 55 bp, Artificial Sequence
  Oligonucleotide for Mutagenesis
cctcatcataaatgtcaaaatcgcacttcttcatttcaactgatatggtatcatc

SEQ ID NO: 72 - DNA, 55 bp, Artificial Sequence
  Oligonucleotide for Mutagenesis
gataccatatcagttgaaatgaagaaggaatgttttgacatttatgatgaggatg

SEQ ID NO: 73 - DNA, 55 bp, Artificial Sequence
  Oligonucleotide for Mutagenesis
catcctcatcataaatgtcaaaacattccttcttcatttcaactgatatggtatc

SEQ ID NO: 74 - DNA, 53 bp, Artificial Sequence
  Oligonucleotide for Mutaagenesis
gaaatgaagaaggaagatttttgcatttatgatgaggatgaaaatcagagccc

SEQ ID NO: 75 - DNA, 53 bp, Artificial Sequence
  Oligonucleotide for Mutagenesis
gggctctgattttcatcctcatcataaatgcaaaaatcttccttcttcatttc

SEQ ID NO: 76 - DNA, 53 bp, Artificial Sequence
  Oligonucleotide for Mutagenesis
gaaatgaagaaggaagattttgactgttatgatgaggatgaaaatcagagccc

SEQ ID NO: 77 - DNA, 53 bp, Artificial Sequence
  Oligonucleotide for Mutagenesis
gggctctgattttcatcctcatcataacagtcaaaatcttccttcttcatttc

SEQ ID NO: 78 - DNA, 47 bp, Artificial Sequence
  Oligonucleotide for Mutagenesis
gaagaaggaagattttgacatttgcgatgaggatgaaaatcagagcc

SEQ ID NO: 79 - DNA, 47 bp, Artificial Sequence
  Oligonucleotide for Mutagenesis
ggctctgattttcatcctcatcgcaaatgtcaaaatcttccttcttc

SEQ ID NO: 80 - DNA, 48 bp, Artificial Sequence
  Oligonucleotide for Mutagenesis
ggaagattttgacatttatgattgcgatgaaaatcagagcccccgcag

SEQ ID NO: 81 - DNA, 48 bp, Artificial Sequence
  Oligonucleotide for Mutagenesis
ctgcgggggctctgattttcatcgcaatcataaatgtcaaaatcttcc

SEQ ID NO: 82 - DNA, 31 bp, Artificial Sequence
  PCR primer
gtggctagcgcatggaaatagagctctccac

SEQ ID NO: 83 - DNA, 40 bp, Artificial Sequence
  PCR primer
cacgcggccgcgttaccggtgtagaggtcctgtgcctcgc

SEQ ID NO: 84 - DNA, 30 bp, Artificial Sequence
  PCR primer
gtgaccggtaactccacagtgagctgtccc

SEQ ID NO: 85 - DNA, 33 bp, Artificial Sequence
  PCR primer
acagcggccgctatcacttgctgcacttcctgg

SEQ ID NO: 86 - DNA, 29 bp, Artificial Sequence
  PCR primer
gtgaccggttgcaacgacatcactgccag

SEQ ID NO: 87 - DNA, 75 bp, Artificial Sequence
  cDNA Sequence (Thrombin cleavage site)
accggtgatgacaactctccttcctttatccaaattcgctcagttgccaagaagcatcctaaaacttggaccggt

SEQ ID NO: 88 - DNA, 93 bp, Artificial Sequence
  cDNA Sequence (Thrombin cleavage site)
accggtgatgaggatgaaaatcagagcccccgcagctttcaaaagaaaacacgacactattttattgctgcagtggagaggctctggaccggt

SEQ ID NO: 89 - DNA, 38 bp, Artificial Sequence
  Oligonucleotide for Mutagenesis
gtgttccctgagctgctgccctcctatggtcaaactgg

SEQ ID NO: 90 - DNA, 38 bp, Artificial Sequence
  Oligonucleotide for Mutagenesis
ccagtttgaccataggagggcagcagctcagggaacac

SEQ ID NO: 91 - DNA, 33 bp, Artificial Sequence
  Oligonucleotide for Mutagenesis
gccgtcgaacagttcgatgcagccgccctcgac

SEQ ID NO: 92 - DNA, 38 bp, Artificial Sequence
  Oligonucleotide for Mutagenesis
ggcctatgaaggacgaatgccatttcgaggtggtcgag

SEQ ID NO: 93 - DNA, 38 bp, Artificial Sequence
  Oligonucleotide for Mutagenesis
ctcgaccacctcgaaatggcattcgtccttcataggcc

SEQ ID NO: 94 - DNA, 48 bp, Artificial Sequence
  Oligonucleotide for Mutagenesis
cctgtccattagtgtggtgtgcaaacagacctatcaggaaaaagtctg

SEQ ID NO: 95 - DNA, 48 bp, Artificial Sequence
  Oligonucleotide for Mutagenesis
cagactttttcctgataggtctgtttgcacaccacactaatggacagg

SEQ ID NO: 96 - DNA, 33 bp, Artificial Sequence
  Oligonucleotide for Mutagenesis
ctagcaacctgcaggtctgcgaggaccccgtgg

SEQ ID NO: 97 - DNA, 33 bp, Artificial Sequence
  Oligonucleotide for Mutagenesis
ccacggggtcctcgcagacctgcaggttgctag

SEQ ID NO: 98 - DNA, 41 bp, Artificial Sequence
  Oligonucleotide for Mutagenesis
ggattgcaacaaactggtctgccctgaaccttacctggacg

SEQ ID NO: 99 - DNA, 41 bp, Artificial Sequence
  Oligonucleotide for Mutagenesis
cgtccaggtaaggttcagggcagaccagtttgttgcaatcc

SEQ ID NO: 100 - DNA, 46 bp, Artificial Sequence
  Oligonucleotide for Mutagenesis
caacaaactggtcgatcctgaatgctacctggacgtgtgtatctac

SEQ ID NO: 101 - DNA, 46 bp, Artificial Sequence
  Oligonucleotide for Mutagenesis
gtagatacacacgtccaggtagcattcaggatcgaccagtttgttg

SEQ ID NO: 102 - DNA, 32 bp, Artificial Sequence
  Oligonucleotide for Mutagenesis
gcgctcagcacggatgcgtcgtgacatggcgc

SEQ ID NO: 103 - DNA, 32 bp, Artificial Sequence
  Oligonucleotide for Mutagenesis
gcgccatgtcacgacgcatccgtgctgagcgc

SEQ ID NO: 104 - DNA, 32 bp, Artificial Sequence
  Oligonucleotide for Mutagenesis
cctgcgaggaacggtgcctgcgcgagaatggc

SEQ ID NO: 105 - DNA, 32 bp, Artificial Sequence
  Oligonucleotide for Mutagenesis
gccattctcgcgcaggcaccgttcctcgcagg

SEQ ID NO: 106 - DNA, 33 bp, Artificial Sequence
  Oligonucleotide for Mutagenesis
cacatgccagcatccctgccccctggcttgtcc

SEQ ID NO: 107 - DNA, 33 bp, Artificial Sequence
  oligonucleotide for Mutagenesis
ggacaagccagggggcagggatgctggcatgtg

SEQ ID NO: 108 - DNA, 31 bp, Artificial Sequence
  Oligonucleotide for Mutagenesis
cgaagtggccggctgcagattcgcctccggc

SEQ ID NO: 109 - DNA, 31 bp, Artificial Sequence
  Oligonucleotide for Mutagenesis
gccggaggcgaatctgcagccggccacttcg

SEQ ID NO: 110 - DNA, 46 bp, Artificial Sequence
  Oligonucleotide for Mutagenesis
gccaccacaattccagaaaatacttgccttcagtcagatcaagagg

SEQ ID NO: 111 - DNA, 46 bp, Artificial Sequence
  Oligonucleotide for Mutagenesis
cctcttgatctgactgaaggcaagtattttctggaattgtggtggc

SEQ ID NO: 112 - DNA, 49 bp, Artificial Sequence
  Oligonucleotide for Mutagenesis
cacaattccagaaaatactactctttgctcagatcaagaggaaattgac

SEQ ID NO: 113 - DNA, 49 bp, Artificial Sequence
  Oligonucleotide for Mutagenesis
gtcaatttcctcttgatctgagcaaagagtagtattttctggaattgtg

SEQ ID NO: 114 - DNA, 49 bp, Artificial Sequence
  Oligonucleotide for Mutagenesis
ctactcttcagtcagatcaatgcgaaattgactatgatgataccatatc

SEQ ID NO: 115 - DNA, 49 bp, Artificial Sequence
  Oligonucleotide for Mutagenesis
gatatggtatcatcatagtcaatttcgcattgatctgactgaagagtag

SEQ ID NO: 116 - DNA, 52 bp, Artificial Sequence
  Oligonucleotide for Mutagenesis
gaaattgactatgatgataccatatgcgttgaaatgaagaaggaagattttg

SEQ ID NO: 117 - DNA, 52 bp, Artificial Sequence
  Oligonucleotide for Mutagenesis
caaaatcttccttcttcatttcaacgcatatggtatcatcatagtcaatttc

SEQ ID NO: 118 - DNA, 48 bp, Artificial Sequence
  Oligonucleotide for Mutagenesis
gactatgatgataccatatcatgcgaaatgaagaaggaagattttgac

SEQ ID NO: 119 - DNA, 48 bp, Artificial Sequence
  Oligonucleotide for Mutagenesis
gtcaaaatcttccttcttcatttcgcatgatatggtatcatcatagtc

SEQ ID NO: 120 - DNA, 49 bp, Artificial Sequence
  Oligonucleotide for Mutagenesis
gatgataccatatcagttgaatgcaagaaggaagattttgacatttatg

SEQ ID NO: 121 - DNA, 49 bp, Artificial Sequence
  Oligonucleotide for Mutagenesis
cataaatgtcaaaatcttccttcttgcattcaactgatatggtatcatc

SEQ ID NO: 122 - DNA, 49 bp, Artificial Sequence
  Oligonucleotide for Mutagenesis
gataccatatcagttgaaatgtgcaaggaagattttgacatttatgatg

SEQ ID NO: 123 - DNA, 49 bp, Artificial Sequence
  Oligonucleotide for Mutagenesis
catcataaatgtcaaaatcttccttgcacatttcaactgatatggtatc

SEQ ID NO: 124 - DNA, 51 bp, Artificial Sequence
  Oligonucleotide for Mutagenesis
ccatatcagttgaaatgaagtgcgaagattttgacatttatgatgaggatg

SEQ ID NO: 125 - DNA, 51 bp, Artificial Sequence
  Oligonucleotide for Mutagenesis
catcctcatcataaatgtcaaaatcttcgcacttcatttcaactgatatgg

SEQ ID NO: 126 - DNA, 53 bp, Artificial Sequence
  Oligonucleotide for Mutagenesis
cagttgaaatgaagaaggaagattgcgacatttatgatgaggatgaaaatcag

SEQ ID NO: 127 - DNA, 53 bp, Artificial Sequence
  Oligonucleotide for Mutagenesis
ctgattttcatcctcatcataaatgtcgcaatcttccttcttcatttcaactg

SEQ ID NO: 128 - DNA, 50 bp, Artificial Sequence
  Oligonucleotide for Mutagenesis
gaagaaggaagattttgacatttattgcgaggatgaaaatcagagccccc

SEQ ID NO: 129 - DNA, 50 bp, Artificial Sequence
  Oligonucleotide for Mutagenesis
gggggctctgattttcatcctcgcaataaatgtcaaaatcttccttcttc

SEQ ID NO: 130 - DNA, 48 bp, Artificial Sequence
  Oligonucleotide for Mutagenesis
ggaagattttgacatttatgatgagtgcgaaaatcagagcccccgcag

SEQ ID NO: 131 - DNA, 48 bp, Artificial Sequence
  Oligonucleotide for Mutagenesis
ctgcgggggctctgattttcgcactcatcataaatgtcaaaatcttcc

SEQ ID NO: 132 - DNA, 48 bp, Artificial Sequence; identical to SEQ ID NO: 130
  Oligonucleotide for Mutagenesis

SEQ ID NO: 133 - DNA, 48 bp, Artificial Sequence; identical to SEQ ID NO: 131
  Oligonucleotide for Mutagenesis

SEQ ID NO: 134 - DNA, 48 bp, Artificial Sequence
  Oligonucleotide for Mutagenesis
ggaagattttgacatttatgatgaggatgaatgccagagcccccgcag

SEQ ID NO: 135 - DNA, 48 bp, Artificial Sequence
  Oligonucleotide for Mutagenesis
ctgcgggggctctggcattcatcctcatcataaatgtcaaaatcttcc

SEQ ID NO: 136 - DNA, 48 bp, Artificial Sequence
  Oligonucleotide for Mutagenesis
gaagattttgacatttatgatgaggatgaaaattgcagcccccgcagc

SEQ ID NO: 137 - DNA, 48 bp, Artificial Sequence
  Oligonucleotide for Mutagenesis
gctgcgggggctgcaattttcatcctcatcataaatgtcaaaatcttc

SEQ ID NO: 138 - DNA, 46 bp, Artificial Sequence
  Oligonucleotide for Mutagenesis
catttatgatgaggatgaaaatcagtgcccccgcagctttcaaaag

SEQ ID NO: 139 - DNA, 46 bp, Artificial Sequence
  Oligonucleotide for Mutagenesis
cttttgaaagctgcgggggcactgattttcatcctcatcataaatg

SEQ ID NO: 140 - DNA, 48 bp, Artificial Sequence
  Oligonucleotide for Mutagenesis
tgatgaggatgaaaatcagagctgccgcagctttcaaaagaaaacacg

SEQ ID NO: 141 - DNA, 48 bp, Artificial Sequence
  Oligonucleotide for Mutagenesis
cgtgttttcttttgaaagctgcggcagctctgattttcatcctcatca

SEQ ID NO: 142 - DNA, 29 bp, Artificial Sequence
  PCR primer
gtgaccggtcaaaggaacgtctcctgccc

SEQ ID NO: 143 - DNA, 33 bp, Artificial Sequence
  Oligonucleotide for Mutagenesis
gtcgagggcggctgcatcgaactgttcgacggc

SEQ ID NO: 144 - DNA, 5645 bp, Artificial Sequence
  Fusion Protein
  misc_feature (1)..(4389)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgatgagc

SEQ ID NO: 145 - DNA, 5213 bp, Artificial Sequence
  Fusion Protein
  CDS (1)..(5211)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtcaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgatgagc

SEQ ID NO: 146 - protein, 1735 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 147 - DNA, 4672 bp, Artificial Sequence
  Fusion Protein
  CDS (1)..(4671)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggttgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgatagc

SEQ ID NO: 148 - protein, 1555 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 149 - DNA, 5714 bp, Artificial Sequence
  Fusion Protein
  CDS (1)..(5712)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggaccggtaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgatgagc

SEQ ID NO: 150 - protein, 1902 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWTGNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 151 - DNA, 5280 bp, Artificial Sequence
  Fusion Protein
  CDS (1)..(5280)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggaccggtcaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgatga

SEQ ID NO: 152 - protein, 1758 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWTGQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 153 - DNA, 4740 bp, Artificial Sequence
  Fusion Protein
  CDS (1)..(4740)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggaccggttgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgatag

SEQ ID NO: 154 - protein, 1578 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWTGCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 155 - DNA, 6939 bp, Artificial Sequence
  Fusion Protein
  CDS (1)..(6939)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgaggatgaaaatcagagcccccgcagctttcaaaagaaaacacgacactattttattgctgcagtggagaggctctggaccggtggctcttctgcctctccagctgcacctgctccagcaagccctgctgcaccagctccgtccgctcctgctgcctctccagctgcacctgctccagcaagccctgctgcaccagctccgtccgctcctgctgcctctcccgctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctcccgctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctcgcgctcctgctgcctctccagctgcacctgctccagcaagccctgctgcaccagctccgtccgctcctgctgcctctccagctgcacctgctccagcaagccctgctgcaccagctccgtccgctcctgctgcctctcccgctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctcccgctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctcgcgctcctgctgccaccggtaactccacagtgagctgtccccttgggtacttggcctcaaccgccaccaatgactgtggctgtaccacaaccacctgccttcccgacaaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcgggcttcacttacgttctgcatgaaggcgagtgctgtggaaggtgcctgccatctgcctgtgaggtggtgactggctcaccgcggggggactcccagtcttcctggaagagtgtcggctcccagtgggcctccccggagaacccctgcctcatcaatgagtgtgtccgagtgaaggaggaggtctttatacaacaaaggaacgtctcctgcccccagctggaggtccctgtctgcccctcgggctttcagctgagctgtaagacctcagcgtgctgcccaagctgtcgctgtgagcgcatggaggcctgcatgctcaatggcactgtcattgggcccgggaagactgtgatgatcgatgtgtgcacgacctgccgctgcatggtgcaggtgggggtcatctctggattcaagctggagtgcaggaagaccacctgcaacccctgccccctgggttacaaggaagaaaataacacaggtgaatgttgtgggagatgtttgcctacggcttgcaccattcagctaagaggaggacagatcatgacactgaagcgtgatgagacgctccaggatggctgtgatactcacttctgcaaggtcaatgagagaggagagtacttctgggagaagagggtcacaggctgcccaccctttgatgaacacaagtgtctggctgagggaggtaaaattatgaaaattccaggcacctgctgtgacacatgtgaggagcctgagtgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 156 - protein, 2312 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDEDENQSPRSFQKKTRHYFIAAVERLWTGGSSASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPARAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPARAPAATGNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 157 - DNA, 5970 bp, Artificial Sequence
  Fusion Protein
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgaggatgaaaatcagagcccccgcagctttcaaaagaaaacacgacactattttattgctgcagtggagaggctctggaccggtggctcttctgcctctccagctgcacctgctccagcaagccctgctgcaccagctccgtccgctcctgctgcctctccagctgcacctgctccagcaagccctgctgcaccagctccgtccgctcctgctgcctctcccgctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctcccgctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctcgcgctcctgctgcctctccagctgcacctgctccagcaagccctgctgcaccagctccgtccgctcctgctgcctctccagctgcacctgctccagcaagccctgctgcaccagctccgtccgctcctgctgcctctcccgctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctccgtccgctcctgctgcctctcccgctgcacctgctccagcaagccctgctgcaccagctccgtccgctcctgctgcctctccagctgcacctgctccagcaagccctgctgcaccagctccgtccgctcctgctgcctctccagctgcacctgctccagcaagccctgctgcaccagctcgcgctcctgctgccaccggttgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgatag

SEQ ID NO: 158 - DNA, 5835 bp, Artificial Sequence
  Fusion Protein
  CDS (1)..(5835)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggctag

SEQ ID NO: 159 - protein, 1944 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGG

SEQ ID NO: 160 - DNA, 6153 bp, Artificial Sequence
  Fusion Protein
  CDS (1)..(6153)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggcgatgaggacgagaatcagtcccctaggagcttccagaagaaaacccggcactacttcattgccgccgtcgaacgtctgtggaccggtagcagtggtggaagcggagggtctggtggttcaggcggatcaggaggaagcggtggctcaggcgggagcggcgggtcaggaggttcaggctccggaggctctggtggatcaggcggtagtggtgggtcaggcggaagcgggagtggagggagtggaggtagtggaggctctggaggcagtggcggatctggaggcagcggaggttctggcggaagcggaggatccgccggtagcctatcctgtcggccccccatggtcaagctggtgtgtcccgctgacaacctgcgggctgaagggctcgagtgtaccaaaacgtgccagaactatgacctggagtgcatgagcatgggctgtgtctctggctgcctctgccccccgggcatggtccggcatgagaacagatgtgtggccctggaaaggtgtccctgcttccatcagggcaaggagtatgcccctggagaaacagtgaagattggctgcaacacttgtgtctgtcgggaccggaagtggaactgcacagaccatgtgtgtgatgccacgtgctccacgatcggcatggcccactacctcaccttcgacgggctcaaatacctgttccccggggagtgccagtacgttctggtgcaggattactgcggcagtaaccctgggacctttcggatcctagtggggaataagggatgcagccacccctcagtgaaatgcaagaaacgggtcaccatcctggtggagggaggagagattgagctgtttgacggggaggtgaatgtgaagaggcccatgaaggatgagactcactttgaggtggtggagtctggccggtacatcattctgctgctgggcaaagccctctccgtggtctgggaccgccacctgagcatctccgtggtcctgaagcagacataccaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtgcctctggactcatcccctgccacctgccataacaacatcatgaagcagacgatggtggattcctcctgtagaatccttaccagtgacgtcttccaggactgcaacaagctggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgcccccagagctgcgaggagaggaatctccgggagaacgggtatgagtgtgagtggcgctataacagctgtgcacctgcctgtcaagtcacgtgtcagcaccctgagccactggcctgccctgtgcagtgtgtggagggctgccatgcccactgccctccagggaaaatcctggatgagcttttgcagacctgcgttgaccctgaagactgtccagtgtgtgaggtggctggccggcgttttgcctcaggaaagaaagtcaccttgaatcccagtgaccctgagcactgccagatttgccactgtgatgttgtcaacctcacctgtgaagcctgccaggagccgggaggctag

SEQ ID NO: 161 - protein, 2050 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDEDENQSPRSFQKKTRHYFIAAVERLWTGSSGGSGGSGGSGGSGGSGGSGGSGGSGGSGSGGSGGSGGSGGSGGSGSGGSGGSGGSGGSGGSGGSGGSGGSGGSAGSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGG

SEQ ID NO: 162 - DNA, 4902 bp, Artificial Sequence
  Fusion Protein
  CDS (1)..(4902)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggcctcgagggggtgggagtggagggtctggagggtcaggcgggtctggcgggtctggtggttccggcggttcaggagggagcggagggagtggcggcagtggaggtagcggtggcagcggtggctccggaggatctggcggctccggaggcagcggaggctccgggtcccaatgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 163 - protein, 1633 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWPRGGGSGGSGGSGGSGGSGGSGGSGGSGGSGGSGGSGGSGGSGGSGGSGGSGGSGSQCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 164 - DNA, 5061 bp, Artificial Sequence
  Fusion Protein
  CDS (1)..(5061)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggcctcgagggggtgggagtggagggagcggtggaagtggtggctcaggaggcagtggaggctctggcggttcaggtggttccggaggtagcggagggtcaggcgggagtggtggcagcggaggaagcggcggcagcggtggctctggtggttcaggcggcagtggagggtccggaggctcaggcggctcaggcgggtcaggcggtagcggcggctcaggaggttccggcgggagcggtggaagcggaggttctggcggaagtggcggctcaggtggctccggtggtagcggtggatcaggaggttctggtgggagcggctccgggtcccaatgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 165 - protein, 1686 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWPRGGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGSGSQCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 166 - DNA, 5214 bp, Artificial Sequence
  Fusion Protein
  CDS (1)..(5214)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggcctcgagggggtgggagtggtggttccggtgggagcggcggctctggtggcagtggaggaagtggaggctctggcggaagcggaggttccggcgggtccggaggctccggtgggtctggcggatcaggtggctcaggtgggtcaggagggtccggcggaagcggcggttcaggcggttctggtggcagcggaggttctggtggctcaggtggctctggaggtagtggtggctcaggtggttcaggtggaagtggcgggagtggtgggtcaggaggtagcggaggatcaggaggcagcggcggttcaggtgggtctggtggttctggtggttctggaggcagcggcggctcaggcggatctggtggaagcggcggctccggcgggagcggagggtcaggtggttctggaggttcaggtggaagtggaggaagcggagggagcggtggaagcggagggtccggcggctctggctccgggtcccaatgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 167 - protein, 1737 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWPRGGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGSGSQCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 168 - DNA, 5367 bp, Artificial Sequence
  Fusion Protein
  CDS (1)..(5367)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggcctcgagggggtgggagtggaggatcaggtggcagtggggggtcaggcggctctggtggctctggcggcagtggtggctcaggcggatcaggaggttctggcggatcaggtggatcaggagggtccggaggtagcggaggatccggcgggagcggcggttcaggcggaagcggtggatctggaggttcaggtggctctggaggatcaggcggttccggaggctcaggcggtagtggtggcagtggaggaagtggcgggtctggcggctctggaggcagcggtggaagcggtgggtctggtggcagcggagggagtggcggcagcggcggaagtggcggttccggcgggagtggcggtagtggtgggagcggtggttcaggaggctcaggtggtagtggtggttccggtgggtccggggggagcggaggaagtggaggctccggcggttccggaggtagtggcggatctggcggaagtggtggaagtggagggagcggaggaagtggaggctccggcggctcaggaggctcaggcggctccggaggttctggcgggagcggtggaagcggaggttccggaggctctggaggctcaggaggcagtggcgggtctggcggcagcggctccgggtcccaatgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 169 - protein, 1788 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWPRGGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGSGSQCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 170 - DNA, 5514 bp, Artificial Sequence
  Fusion Protein
  CDS (1)..(5514)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggcctcgagggggtgggagtggaggatcaggtggcagtggggggtcaggcggctctggtggctctggcggcagtggtggctcaggcggatcaggaggttctggcggatcaggtggatcaggagggtccggaggtagcggaggatccggcgggagcggcggttcaggcggaagcggtggatctggaggttcaggtggctctggaggatcaggcggttccggaggctcaggcggtagtggtggcagtggaggaagtggcgggtctggcggctctggaggcagcggtggaagcggtgggtctggtggcagcggagggagtggcggcagcggcggaagtggcggttccggcgggagtggcggtagtggtgggagcggtggttcaggaggctcaggtggtagtggtggttccggtgggtccggggggagcggaggaagtggaggctccggcggttccggaggtagtggcggatctggcggaagtggtggaagtggagggagcggaggaagtggaggctccggcggctcaggaggctcaggcggctccggaggttctggcgggagcggtggaagcggaggttccggaggctctggaggctcaggaggcagtggcgggtctggcggcagcggtggttccggtgggagcggcggctctggtggcagtggaggaagtggaggctctggcggaagcggaggttccggcgggtccggaggctccggtgggtctggcggatcaggtggctcaggtgggtcaggagggtccggcggaagcggcggctccgggtcccaatgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 171 - protein, 1837 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWPRGGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGSQCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 172 - DNA, 5664 bp, Artificial Sequence
  Fusion Protein
  CDS (1)..(5664)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggcctcgagggggtgggagtggaggatcaggtggcagtggggggtcaggcggctctggtggctctggcggcagtggtggctcaggcggatcaggaggttctggcggatcaggtggatcaggagggtccggaggtagcggaggatccggcgggagcggcggttcaggcggaagcggtggatctggaggttcaggtggctctggaggatcaggcggttccggaggctcaggcggtagtggtggcagtggaggaagtggcgggtctggcggctctggaggcagcggtggaagcggtgggtctggtggcagcggagggagtggcggcagcggcggaagtggcggttccggcgggagtggcggtagtggtgggagcggtggttcaggaggctcaggtggtagtggtggttccggtgggtccggggggagcggaggaagtggaggctccggcggttccggaggtagtggcggatctggcggaagtggtggaagtggagggagcggaggaagtggaggctccggcggctcaggaggctcaggcggctccggaggttctggcgggagcggtggaagcggaggttccggaggctctggaggctcaggaggcagtggcgggtctggcggcagcggtggttccggtgggagcggcggctctggtggcagtggaggaagtggaggctctggcggaagcggaggttccggcgggtccggaggctccggtgggtctggcggatcaggtggctcaggtgggtcaggagggtccggcggaagcggcggttcaggcggttctggtggcagcggaggttctggtggctcaggtggctctggaggtagtggtggctcaggtggttcaggtggaagtggcgggagtggtgggtcaggaggtagcggaggatcaggaggcagcggcggttcaggtgggtctggctccgggtcccaatgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 173 - protein, 1887 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWPRGGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGSGSQCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 174 - DNA, 5817 bp, Artificial Sequence
  Fusion Protein
  CDS (1)..(5817)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggcctcgagggggtgggagtggaggatcaggtggcagtggggggtcaggcggctctggtggctctggcggcagtggtggctcaggcggatcaggaggttctggcggatcaggtggatcaggagggtccggaggtagcggaggatccggcgggagcggcggttcaggcggaagcggtggatctggaggttcaggtggctctggaggatcaggcggttccggaggctcaggcggtagtggtggcagtggaggaagtggcgggtctggcggctctggaggcagcggtggaagcggtgggtctggtggcagcggagggagtggcggcagcggcggaagtggcggttccggcgggagtggcggtagtggtgggagcggtggttcaggaggctcaggtggtagtggtggttccggtgggtccggggggagcggaggaagtggaggctccggcggttccggaggtagtggcggatctggcggaagtggtggaagtggagggagcggaggaagtggaggctccggcggctcaggaggctcaggcggctccggaggttctggcgggagcggtggaagcggaggttccggaggctctggaggctcaggaggcagtggcgggtctggcggcagcggtggttccggtgggagcggcggctctggtggcagtggaggaagtggaggctctggcggaagcggaggttccggcgggtccggaggctccggtgggtctggcggatcaggtggctcaggtgggtcaggagggtccggcggaagcggcggttcaggcggttctggtggcagcggaggttctggtggctcaggtggctctggaggtagtggtggctcaggtggttcaggtggaagtggcgggagtggtgggtcaggaggtagcggaggatcaggaggcagcggcggttcaggtgggtctggtggttctggtggttctggaggcagcggcggctcaggcggatctggtggaagcggcggctccggcgggagcggagggtcaggtggttctggaggttcaggtggaagtggaggaagcggagggagcggtggaagcggagggtccggcggctctggctccgggtcccaatgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 175 - protein, 1938 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWPRGGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGSGSQCNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 176 - DNA, 5970 bp, Artificial Sequence
  Fusion Protein
  CDS (1)..(5970)
atggaaatagagctctccacctgcttctttctgtgccttttgcgattctgctttagtgccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggcgtccttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctcccagaattcaagacaccctagcactaggcaaaagcaatttaatgccaccacaattccagaaaatactactcttcagtcagatcaagaggaaattgactatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacaccggtgatgacaactctccttcctttatccaaattcgctcagttgccaagaagcatcctaaaacttggcctcgagggggtgggagtggaggatcaggtggcagtggggggtcaggcggctctggtggctctggcggcagtggtggctcaggcggatcaggaggttctggcggatcaggtggatcaggagggtccggaggtagcggaggatccggcgggagcggcggttcaggcggaagcggtggatctggaggttcaggtggctctggaggatcaggcggttccggaggctcaggcggtagtggtggcagtggaggaagtggcgggtctggcggctctggaggcagcggtggaagcggtgggtctggtggcagcggagggagtggcggcagcggcggaagtggcggttccggcgggagtggcggtagtggtgggagcggtggttcaggaggctcaggtggtagtggtggttccggtgggtccggggggagcggaggaagtggaggctccggcggttccggaggtagtggcggatctggcggaagtggtggaagtggagggagcggaggaagtggaggctccggcggctcaggaggctcaggcggctccggaggttctggcgggagcggtggaagcggaggttccggaggctctggaggctcaggaggcagtggcgggtctggcggcagcggaggatcaggtggcagtggggggtcaggcggctctggtggctctggcggcagtggtggctcaggcggatcaggaggttctggcggatcaggtggatcaggagggtccggaggtagcggaggatccggcgggagcggcggttcaggcggaagcggtggatctggaggttcaggtggctctggaggatcaggcggttccggaggctcaggcggtagtggtggcagtggaggaagtggcgggtctggcggctctggaggcagcggtggaagcggtgggtctggtggcagcggagggagtggcggcagcggcggaagtggcggttccggcgggagtggcggtagtggtgggagcggtggttcaggaggctcaggtggtagtggtggttccggtgggtccggggggagcggaggaagtggaggctccggcggttccggaggtagtggcggatctggcggaagtggtggaagtggagggagcggaggaagtggaggctccggcggctcaggaggctcaggcggctccggaggttctggcgggagcggtggaagcggaggttccggaggctctggaggctcaggaggcagtggcgggtctggcggcagcggctccgggtcccaatgcaacgacatcactgccaggctgcagtatgtcaaggtgggaagctgtaagtctgaagtagaggtggatatccactactgccagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtga

SEQ ID NO: 177 - protein, 1989 aa, Artificial Sequence
  Synthetic Construct
MEIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYTGDDNSPSFIQIRSVAKKHPKTWPRGGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGSGSQCNDITARLQYVKVGSCKSEVEVDIHYCQGKCASKAMYSIDINDVQDQCSCCSPTRTEPMQVALHCTNGSVVYHEVLNAMECKCSPRKCSK

The invention claimed is:

1. A complex comprising von Willebrand factor (VWF) covalently linked to Factor VIII (FVIII), wherein the complex comprises a half-life extending moiety, with the proviso that the complex is not a heterodimeric Fc fusion with one Fc monomer linked to VWF and the other Fc monomer linked to Factor VIII, and wherein the Factor VIII is modified by substitution of a naturally occurring amino acid with a cysteine residue or insertion of a cysteine residue which forms a disulphide bridge with a cysteine residue in VWF.

2. The complex of claim 1, wherein the naturally occurring amino acid in Factor VIII that is substituted is selected from an amino acid in the Factor VIII a3 domain.

3. The complex of claim 1, wherein the naturally occurring amino acid in Factor VIII that is substituted is located within amino acids 1653 to 1660 or within amino acids 1667 to 1674 or within amino acids 1675 to 1688 of the FVIII a3 domain, or the inserted cysteine is introduced into the sequence of amino acids 1653 to 1660 or amino acids 1667 to 1674 or amino acids 1675 to 1688 of the FVIII a3 domain.

4. The complex of claim 1, wherein the naturally occurring amino acid that is substituted in Factor VIII is in the C-terminal domain.

5. The complex of claim 1, wherein the VWF is modified by substitution of a naturally occurring amino acid with a cysteine residue or insertion of a cysteine residue which forms the disulphide bridge with the cysteine residue substituted in the Factor VIII or the cysteine residue inserted into the Factor VIII.

6. The complex of claim 5, wherein the naturally occurring amino acid in VWF is an amino acid in the D' or D3 domain, or wherein the inserted cysteine residue in the VWF is in the D' or D3 domain.

7. The complex of claim 5, wherein the inserted cysteine residue in the VWF is introduced in the TIL' domain, the E' domain, the D3 domain, the C8-3 domain, the TIL-3 domain or the E-3 domain of VWF, or the naturally occurring amino acid in the VWF is in the TIL' domain, the E' domain, the D3 domain, the C8-3 domain, the TIL-3 domain or the E-3 domain of VWF.

8. The complex of claim 1, wherein the VWF comprises a FVIII binding domain.

9. The complex of claim 1, wherein the Factor VIII is a genetically engineered Factor VIII.

10. The complex of claim 9, wherein the engineered Factor VIII has a full or partial B-domain deletion, or is a mutated Factor VIII comprising one or more amino acid substitutions, insertions, deletions or combinations thereof, or is a fusion polypeptide with a half-life extending moiety.

11. The complex of claim 1, wherein the VWF is a half-life extended form of VWF.

12. The complex of claim 11, wherein the half-life extended form of VWF is a genetically engineered fusion protein of VWF with a half-life extending moiety.

13. The complex of claim 11, wherein the half-life extending moiety is selected from albumin or a variant or fragment thereof, an immunoglobulin constant region or a portion or variant thereof, an Fc fragment or variant thereof, a solvated random chain with large hydrodynamic volume, afamin or a variant thereof, alpha-fetoprotein or a variant thereof, Vitamin D binding protein or a variant thereof, transferrin or a variant thereof, a carboxyl-terminal peptide (CTP) of human chorionic gonadotropin-βsubunit, and a polypeptide or lipid capable of binding under physiological conditions to albumin or an immunoglobulin constant region.

14. The complex of claim 1, wherein the plasma half-life of VWF is extended by one or more chemical modifications selected from polyethylene glycol (PEGylation), glycosylated PEG, hydroxyl ethyl starch (HESylation), polysialic acids, heparosan polymers, elastin-like polypeptides and hyaluronic acid.

15. The complex of claim 1, wherein the VWF is expressed as a monomer or a dimer.

16. The complex of claim 1, wherein the VWF forms a multimer.

17. The complex of claim 1, wherein the covalent link is obtained by one or more chemically synthesized cross-linkers.

18. A method for treatment of hemophilia A or von Willebrand disease, comprising administering to a subject in need thereof an effective amount of the complex of claim 1.

19. A pharmaceutical composition comprising the complex of claim 1.

20. The complex of claim 1, wherein the Factor VIII is modified by substitution of a naturally occurring amino acid with a cysteine residue.

* * * * *